(12) United States Patent
Chaudhary

(10) Patent No.: US 12,269,859 B2
(45) Date of Patent: *Apr. 8, 2025

(54) SYNTHETIC IMMUNE RECEPTORS AND METHODS OF USE THEREOF

(71) Applicant: Angeles Therapeutics, Inc., Toluca Lake, CA (US)

(72) Inventor: Preet M. Chaudhary, Toluca Lake, CA (US)

(73) Assignee: Angeles Therapeutics, Inc., Toluca Lake, CA (US)

( * ) Notice: Subject to any disclaimer, the term of this patent is extended or adjusted under 35 U.S.C. 154(b) by 944 days.

This patent is subject to a terminal disclaimer.

(21) Appl. No.: 16/465,668

(22) PCT Filed: Dec. 2, 2017

(86) PCT No.: PCT/US2017/064379
§ 371 (c)(1),
(2) Date: May 31, 2019

(87) PCT Pub. No.: WO2018/102795
PCT Pub. Date: Jun. 7, 2018

(65) Prior Publication Data
US 2022/0204582 A1   Jun. 30, 2022

Related U.S. Application Data

(60) Provisional application No. 62/429,619, filed on Dec. 2, 2016, provisional application No. 62/429,597, filed on Dec. 2, 2016.

(51) Int. Cl.
| | |
|---|---|
| *C07K 14/705* | (2006.01) |
| *A61K 39/00* | (2006.01) |
| *A61K 45/06* | (2006.01) |
| *C07K 14/725* | (2006.01) |
| *C07K 16/28* | (2006.01) |
| *C07K 16/30* | (2006.01) |

(Continued)

(52) U.S. Cl.
CPC ...... *C07K 14/7051* (2013.01); *A61K 39/4611* (2023.05); *A61K 39/4621* (2023.05); *A61K 39/4631* (2023.05); *A61K 39/4632* (2023.05); *A61K 39/46433* (2023.05); *A61K 39/4644* (2023.05); *A61K 39/464403* (2023.05); *A61K 39/464404* (2023.05); *A61K 39/464406* (2023.05); *A61K 39/46441* (2023.05); *A61K 39/464412* (2023.05); *A61K 39/464417* (2023.05); *A61K 39/464418* (2023.05); *A61K 39/464419* (2023.05); *A61K 39/464424* (2023.05); *A61K 39/464429* (2023.05); *A61K 39/464453* (2023.05); *A61K 39/464456* (2023.05); *A61K 39/464457* (2023.05); *A61K 39/464466* (2023.05); *A61K 39/464468* (2023.05); *A61K 39/46447* (2023.05); *A61K 39/464471* (2023.05); *A61K 39/464488* (2023.05); *A61K 39/464491* (2023.05); *A61K 39/464492* (2023.05); *A61K 39/464495* (2023.05); *A61K 39/464838* (2023.05); *A61K 45/06* (2013.01); *C07K 14/70517* (2013.01); *C07K 16/2803* (2013.01); *C07K 16/2851* (2013.01); *C07K 16/2863* (2013.01); *C07K 16/2866* (2013.01); *C07K 16/2869* (2013.01); *C07K 16/2878* (2013.01); *C07K 16/2887* (2013.01); *C07K 16/2896* (2013.01); *C07K 16/30* (2013.01); *C07K 16/32* (2013.01); *C07K 19/00* (2013.01); *A61K 2239/28* (2023.05); *A61K 2239/29* (2023.05); *A61K 2239/31* (2023.05); *A61K 2239/38* (2023.05); *A61K 2239/47* (2023.05); *A61K 2239/48* (2023.05); *A61K 2239/59* (2023.05); *C07K 2317/622* (2013.01); *C07K 2319/03* (2013.01); *C07K 2319/32* (2013.01); *C07K 2319/33* (2013.01); *C07K 2319/50* (2013.01)

(58) Field of Classification Search
CPC ............ C07K 2319/33; C07K 2319/32; C07K 2319/03; C07K 2319/00; C07K 2317/31; C07K 2317/56; C07K 2317/565; C07K 2317/52; C07K 2317/622; C07K 14/70596; C07K 16/2896; C07K 16/2866; C07K 16/30; C07K 14/705
See application file for complete search history.

(56) References Cited

U.S. PATENT DOCUMENTS

| | | | |
|---|---|---|---|
| 4,708,871 | A | 11/1987 | Geysen |
| 5,199,942 | A | 4/1993 | Gillis |

(Continued)

FOREIGN PATENT DOCUMENTS

| | | |
|---|---|---|
| CL | 201701314 | 5/2017 |
| EP | 0 340 793 A2 | 11/1989 |

(Continued)

OTHER PUBLICATIONS

Bhattacharya et al. Impact of genetic variation on three dimensional structure and function of proteins. PLoS One 12(3): e0171355, 2017.*

(Continued)

*Primary Examiner* — Bridget E Bunner
(74) *Attorney, Agent, or Firm* — IPath PLC; Steven J. Miller

(57) ABSTRACT

The disclosure provides synthetic immune receptors (SIRs), nucleic acids encoding the SIRs, methods of making and using the SIRs, in, for example, adoptive cell therapy.

23 Claims, 26 Drawing Sheets
Specification includes a Sequence Listing.

(51) Int. Cl.
 *C07K 16/32* (2006.01)
 *C07K 19/00* (2006.01)
 *A61K 38/17* (2006.01)

(56) References Cited

U.S. PATENT DOCUMENTS

| | | | |
|---|---|---|---|
| 5,585,089 | A | 12/1996 | Queen et al. |
| 5,912,172 | A | 6/1999 | Eshhar et al. |
| 6,703,199 | B1 | 3/2004 | Koide |
| 7,666,604 | B2 * | 2/2010 | Jakobsen ............... A61P 35/00 435/7.1 |
| 7,741,465 | B1 | 6/2010 | Eshhar et al. |
| 9,422,547 | B1 | 8/2016 | Johnson et al. |
| 2005/0009025 | A1 | 1/2005 | Jakobsen et al. |
| 2006/0034810 | A1 | 2/2006 | Riley et al. |
| 2011/0014169 | A1 | 1/2011 | Boulter et al. |
| 2012/0093842 | A1 | 4/2012 | Eshhar et al. |
| 2012/0321667 | A1 | 12/2012 | Sentman |
| 2013/0315884 | A1 | 11/2013 | Galetto et al. |
| 2014/0256706 | A1 | 9/2014 | Wang et al. |
| 2015/0139943 | A1 | 5/2015 | Campana et al. |
| 2015/0203817 | A1 | 7/2015 | Galetto et al. |
| 2016/0081314 | A1 | 3/2016 | Thurston et al. |
| 2016/0083449 | A1 | 3/2016 | Schmitt et al. |
| 2016/0348073 | A1 | 12/2016 | Meissner et al. |
| 2018/0085457 | A1 * | 3/2018 | Lu ..................... C07K 16/2833 |

FOREIGN PATENT DOCUMENTS

| | | |
|---|---|---|
| EP | 943 665 A1 | 9/1999 |
| JP | 2-174681 A | 7/1990 |
| JP | 2006-502741 A | 1/2006 |
| JP | 2007-537743 A | 12/2007 |
| WO | 02/088170 A2 | 11/2002 |
| WO | 03/024388 A2 | 3/2003 |
| WO | 03/043583 A2 | 5/2003 |
| WO | 03/068201 A2 | 8/2003 |
| WO | 03/070752 A2 | 8/2003 |
| WO | 2004/094477 A1 | 11/2004 |
| WO | 2004/103404 A1 | 12/2004 |
| WO | 2005/037989 A2 | 4/2005 |
| WO | 2005/102387 A2 | 11/2005 |
| WO | 2006/002774 A1 | 1/2006 |
| WO | 2006/039418 A2 | 4/2006 |
| WO | WO-2006037960 A2 * | 4/2006 |
| WO | 2006/071441 A2 | 7/2006 |
| WO | 2006/074397 A2 | 7/2006 |
| WO | 2006/084264 A2 | 8/2006 |
| WO | 2007/002223 A2 | 1/2007 |
| WO | 2007/067730 A2 | 6/2007 |
| WO | 2007/067992 A2 | 6/2007 |
| WO | 2007/076950 A1 | 7/2007 |
| WO | 2007/103469 A2 | 9/2007 |
| WO | 2007/140371 A2 | 12/2007 |
| WO | 2008/031056 A2 | 3/2008 |
| WO | 2008/103613 A2 | 8/2008 |
| WO | 2008/144891 A1 | 12/2008 |
| WO | 2009/007222 A1 | 1/2009 |
| WO | 2010/066803 A2 | 6/2010 |
| WO | 2010/093480 A2 | 8/2010 |
| WO | 2010/095031 A2 | 8/2010 |
| WO | 2010/107658 A2 | 9/2010 |
| WO | 2010/123874 A1 | 10/2010 |
| WO | 2011/009090 A1 | 1/2011 |
| WO | 2011/050242 A1 | 4/2011 |
| WO | 2011/060076 A1 | 5/2011 |
| WO | 2011/119979 A2 | 9/2011 |
| WO | 2011/142858 A2 | 11/2011 |
| WO | 2011/144749 A1 | 11/2011 |
| WO | 2012/010561 A1 | 1/2012 |
| WO | 2012/012695 A2 | 1/2012 |
| WO | 2012/033696 A1 | 3/2012 |
| WO | 2012/042026 A1 | 4/2012 |
| WO | 2012/045752 A1 | 4/2012 |
| WO | 2012/058460 A2 | 5/2012 |
| WO | 2012/135854 A2 | 10/2012 |
| WO | 2012/163805 A1 | 12/2012 |
| WO | 2012/170785 A1 | 12/2012 |
| WO | 2013/019730 A1 | 2/2013 |
| WO | 2013/024097 A1 | 2/2013 |
| WO | 2013/059343 A1 | 4/2013 |
| WO | 2013/072415 A1 | 5/2013 |
| WO | 2013/076183 A1 | 5/2013 |
| WO | 2013/126746 A2 | 8/2013 |
| WO | 2013/130565 A1 | 9/2013 |
| WO | 2013/138244 A2 | 9/2013 |
| WO | 2013/167259 A1 | 11/2013 |
| WO | 2013/169625 A1 | 11/2013 |
| WO | 2013/173496 A2 | 11/2013 |
| WO | 2014/039513 A2 | 3/2014 |
| WO | 2014/052064 A1 | 4/2014 |
| WO | 2014/081944 A2 | 5/2014 |
| WO | 2014/083208 A1 | 6/2014 |
| WO | 2014/089354 A1 | 6/2014 |
| WO | 2014/102299 A2 | 7/2014 |
| WO | 2014/114801 A1 | 7/2014 |
| WO | 2014/134165 A1 | 9/2014 |
| WO | 2014/138315 A1 | 9/2014 |
| WO | 2014/138704 A1 | 9/2014 |
| WO | 2014/152361 A1 | 9/2014 |
| WO | 2014/153270 A1 | 9/2014 |
| WO | 2014/160627 A1 | 10/2014 |
| WO | 2014/180306 A1 | 11/2014 |
| WO | 2014/186469 A2 | 11/2014 |
| WO | 2014/190273 A1 | 11/2014 |
| WO | 2014/191527 A1 | 12/2014 |
| WO | 2015/011450 A1 | 1/2015 |
| WO | 2015/017755 A1 | 2/2015 |
| WO | 2015/026892 A1 | 2/2015 |
| WO | 2015/026894 A2 | 2/2015 |
| WO | 2015/052538 A1 | 4/2015 |
| WO | 2015/057852 A1 | 4/2015 |
| WO | 2015/077789 A2 | 5/2015 |
| WO | 2015/080981 A1 | 6/2015 |
| WO | 2015/089344 A1 | 6/2015 |
| WO | 2015/108203 A1 | 7/2015 |
| WO | 2015/112626 A1 | 7/2015 |
| WO | 2015/120180 A1 | 8/2015 |
| WO | 2015/132598 A1 | 9/2015 |
| WO | 2015/132602 A1 | 9/2015 |
| WO | 2015/142675 A2 | 9/2015 |
| WO | 2015/150327 A1 | 10/2015 |
| WO | 2015/159076 A1 | 10/2015 |
| WO | 2015/164759 A2 | 10/2015 |
| WO | 2015/168613 A2 | 11/2015 |
| WO | 2015/173112 A1 | 11/2015 |
| WO | WO-2015184228 A1 * | 12/2015 |
| WO | 2016/004108 A2 | 1/2016 |
| WO | 2016/014565 A2 | 1/2016 |
| WO | 2016/014576 A1 | 1/2016 |
| WO | 2016/016412 A1 | 2/2016 |
| WO | 2016/024195 A1 | 2/2016 |
| WO | 2016/025880 A1 | 2/2016 |
| WO | 2016/026742 A1 | 2/2016 |
| WO | 2016/030414 A1 | 3/2016 |
| WO | 2016/036937 A1 | 3/2016 |
| WO | 2016/036973 A1 | 3/2016 |
| WO | 2016/040441 A1 | 3/2016 |
| WO | 2016/040868 A1 | 3/2016 |
| WO | 2016/049459 A1 | 3/2016 |
| WO | 2016/070089 A2 | 5/2016 |
| WO | 2016/081490 A1 | 5/2016 |
| WO | 2016/070119 A1 | 6/2016 |
| WO | 2016/090312 A1 | 6/2016 |
| WO | 2016/090327 A2 | 6/2016 |
| WO | 2016/090329 A2 | 6/2016 |
| WO | 2016/094304 A1 | 6/2016 |
| WO | 2016102965 A1 | 6/2016 |
| WO | 2016/116626 A1 | 7/2016 |
| WO | 2016/120220 A1 | 8/2016 |
| WO | 2016/126488 A1 | 8/2016 |
| WO | 2016/154047 A1 | 9/2016 |
| WO | 2016/160618 A2 | 10/2016 |
| WO | 2016/166630 A1 | 10/2016 |

(56) References Cited

FOREIGN PATENT DOCUMENTS

| WO | 2016/168595 | A1 |   | 10/2016 |
|----|-------------|----|---|---------|
| WO | 2016/176639 | A1 |   | 11/2016 |
| WO | 2016/179534 | A2 |   | 11/2016 |
| WO | 2016/180969 | A1 |   | 11/2016 |
| WO | WO-2016187349 | A1 | * | 11/2016 |
| WO | 2016/201124 | A2 |   | 12/2016 |
| WO | 2017/040195 | A1 |   | 3/2017 |
| WO | 2017/049166 | A1 |   | 3/2017 |
| WO | 2017/066481 | A1 |   | 4/2017 |
| WO | WO-2017070608 | A1 | * | 4/2017 |
| WO | 2017/079121 | A2 |   | 5/2017 |
| WO | 2017/173256 | A1 |   | 10/2017 |
| WO | 2017/173349 | A1 |   | 10/2017 |
| WO | 2017/173403 | A1 |   | 10/2017 |
| WO | 2017/190100 | A1 |   | 11/2017 |
| WO | WO-2017192536 | A1 | * | 11/2017 |
| WO | 2018/013993 | A1 |   | 1/2018 |
| WO | 2018/014038 | A1 |   | 1/2018 |
| WO | 2018/053542 | A1 |   | 3/2018 |
| WO | 2020/142672 | A2 |   | 7/2020 |

OTHER PUBLICATIONS

Bork, P. Powers and pitfalls in sequence analysis: the 70% hurdle. Genome Res 10: 398-400, 2000.*
Bork, P. Go hunting in sequence databases but watch out for the traps. Trends in Genetics 12(10): 425-427, 1996.*
Brenner. S.E. Errors in genome annotation. Trends in Genetics 15:132-133, 1999.*
Brorson et al. Mutational analysis of avidity and fine specificity of anti-levan antibodies. J Immunol 163: 6694-6701, 1999.*
Brummell et al. Probing the combining site of an anti-carbohydrate antibody by saturation-mutagenesis: role of the heavy-chain CDR3 residues. Biochem 32(4): 1180-1187, 1993.*
Burks et al. In vitro scanning saturation mutagenesis of an antibody binding pocket. Proc Natl Acad Sci USA 94: 412-417, 1997.*
Cassett et al. A peptide mimetic of an anti-CD4 monoclonal antibody by rationale design. Biochem Biophys Res Comm 307: 198-205, 2003.*
Chen et al. J Mol Biol 293: 865-881, 1999.*
Colman Research in Immunol. 145:33-36, 1994.*
De Pascalis et al. Grafting and "abbreviated" complementarity-determining regions containing specificity-determining residues essential for ligand contact to engineer a less immunogenic humanized monoclonal antibody. J Immunol 169: 3076-3084, 2002.*
Doerks et al. Protein annotation: detective work for function prediction. Trends in Genetics 14:248-250, 1998.*
Dotti et al. Design and development of therapies using chimeric angigen receptor-expressing T cells. Immunol Rev 257: 107-126, 2014.*
Fenton et al. Rheostat positions: a new classification of protein positions relevant to pharmacogenomics. Medicinal Chem Res 29: 1133-1146, 2020.*
Guo et al. Protein tolerance to random amino acid change. Proc Natl Acad Sci USA 101(25): 9205-9210, 2004.*
Holm et al. Functional mapping and single chain construction of the anti-cytokeratin 8 monoclonal antibody TS1. Mol Immunol 44: 1075-1084, 2007.*
Jang et al. The structural basis for DNA binding by an anti-DNA autobody. Mol Immunol 35: 1207-1217, 1998.*
Kobayashi et al. Tryptophan H33 plays an important role in pyrimidine (6-4) pyrimidone photoproduct binding by a high-affinity antibody. Protein Engineering 12(10): 879-884, 1999.*
Li et al. CD19, from bench to bedside. Immunol Lett 183: 86-95, 2017.*
MacCallum et al. Antibody-antigen interactions: contact analysis and binding site topography. J Mol Biol 262: 732-745, 1996.*
Ngo et al. "Computational complexity, protein structure prediction, and the Levinthal paradox" in the Protein Folding Problem and Tertiary Structure Prediction, pp. 492-495, 1994.*

Paul, William E., Fundamental Immunology, 3rd Edition, Raven Press, New York, Chapt. 8, pp. 292-295 (1993).*
Rudikoff et al. Single amino acid substitution altering antigen-binding specificity. Proc Natl Acad Sci USA 79: 1979-1983, 1982.*
Sela-Culang et al. The structural basis of antibody-antigen recognition. Front Immunol 4: 302, 2013 (13 total pages).*
Skolnick et al. From genes to protein structure and function: novel applications of computational approaches in the genomic era. Trends Biotechnol 18(I):34-39 2000.*
Smith et al. The challenges of genome sequence annotation or "the devil is in the details". Nature Biotechnol 15: 1222-1223, 1997.*
Tokuriki et al. Stability effects of mutations and protein evolvability. Curr Opin Structural Biol 19: 596-604, 2009.*
Vajdos et al. Comprehensive functional maps of the antigen-binding site of an anti-ErbB2 antibody obtained with shotgun scanning mutagenesis. J Mol Biol 320: 415-428, 2002.*
Vasudevan et al. A single amino acid change in the binding pocket alters specificity of an anti-integrin antibody AP7.4 as revealed by its crystal structure. Blood Cells Mol Diseases 32: 176-181, 2004.*
Wang et al. CD19: a biomarker for B cell development, lymphoma diagnosis and therapy. Exp Hematol Oncol 1: 36, 2012 (7 total pages).*
Wells, J.A. Additivity of mutational effects in proteins. Biochemistry 29(37): 8509-8517, 1990.*
Wu et al. Humanization of a murine monoclonal antibody by simultaneous optimization of framework and CDR residues. J Mol Biol 294: 151-162, 1999.*
Zhang et al. Comprehensize optimization of a single-chain variable domain antibody fragment as a targeting ligand for a cytotoxic nanoparticle. mAbs 7(1): 42-52, 2015.*
Nadler, L M et al., "B4, a human B lymphocyte-associated antigen expressed on normal, mitogen-activated, and malignant B lymphocytes", J. Immunol., Jul. 1983, 131(1):244-50.
Toro Contreras, Andres Alejando, Chile Office Action, Application No. 201901480, Jan. 31, 2021.
Meier et al., "Current immunotherapy in rheumatoid arthritis", Immunotherapy, 2013, 5(9), pp. 955-974.
Wu, Qi, Second Written Opinion, Intellectual Property Office of Singapore, Jul. 7, 2022.
Gross et al., "Endowing T cells with antibody specificity using chimeric T cell receptors," The FASEB Journal, vol. 6, Dec. 1992, pp. 3370-3378.
Wu, Qi, Search Report and Written Opinion, Application No. 11201904956Y, Intellectual Property Office of Singapore, Aug. 14, 2020.
Kitamura, Yumiko, Office Action, Japan Patent Office, Application No. 2019-529518, Feb. 8, 2022.
Brocker, Thomas et al., "Redirecting the complete T cell receptor/CD3 signaling machinery towards native antigen via modified T cell receptor", Eur. J. Immunol., Jan. 1, 1996, pp. 1770-1774.
Goverman, Joan et al., "Chimeric immunoglobulin-T cell receptor proteins form functional receptors: Implications for T cell receptor complex formation and activation", Cell, Mar. 23, 1990, vol. 60, Issue 6, pp. 929-939.
Gross, Gideon et al., "Expression of immunoglobulin-T-cell receptor chimeric molecules as functional receptors with antibody-type specificity", PNAS, vol. 86(24), Dec. 1, 1989, pp. 10024-10028.
Grotzinger, Thilo, Extended European Search Report, Application No. 17876619.2, European Patent Office, Jul. 17, 2020.
Kuwana Y. et al., "Expression of chimeric receptor composed of immunoglobulin-derived V resions and T-cell receptor-derived C regions", Biochemical and Biophysical Research Communications, vol. 149, No. 3, Dec. 31, 1987, pp. 960-968.
Copenheaver, Blaine R., International Search Report and Written Opinion, United States Patent and Trademark Office, PCT/US2017/064379, May 8, 2018.
Nickitas-Etienne, Athina, International Preliminary Report on Patentability and Written Opinion, The International Bureau of WIPO, PCT/US2017/064379, Jun. 13, 2019.
Syafrizal, Office Action, Indonesia Patent Office, Application No. PID201905496, May 15, 2023.

(56) References Cited

OTHER PUBLICATIONS

Aggen et al., "Single-chain VaVβ T-cell receptors function without mispairing with endogenous TCR chains," Gene Ther. 19(4):365-74, Apr. 2012.
Becker et al., "Expression of a hybrid immunoglobulin-T cell receptor protein in transgenic mice," Cell, 58(5):911-21, Sep. 8, 1989.
Bialer et al., "Selected murine residues endow human TCR with enhanced tumor recognition," J Immunol, 184(11):6232-6241, Apr. 28, 2010.
Bolhuis et al., "Engineering T Lymphocyte Antigen Specificity," Journal of Cellular Biochemistry, 47:306-310, Dec. 1991.
Cohen et al., "Enhanced antitumor activity of murine-human hybrid T-cell receptor (TCR) in human lymphocytes is associated with improved pairing and TCR/CD3 stability," Cancer Res., 66(17):8878-8886, Sep. 1, 2006.
Cohen et al., "Enhanced antitumor activity of T cells engineered to express T-cell receptors with a second disulfide pond," Cancer Res., 67(8):3898-3903, Apr. 15, 2007.
Eshhar et al., "Specific activation and targeting of cytotoxic lymphocytes through chimeric single chains consisting of antibody-binding domains and the gamma or zeta subunits of the immunoglobulin and T-cell receptors," Proc. Natl. Acad. Sci. U S A., 90:720-724, Jan. 1993.
Eshhar et al., "Chimeric T cell receptor which incorporates the anti-tumour specificity of a monoclonal antibody with the cytolytic activity of T cells: a model system for immunotherapeutical approach," Br J Cancer Suppl., 10:27-29, Jul. 1990.
Eshhar et al., "The Emergence of T-Bodies/CAR T Cells," The Cancer Journal, vol. 20, No. 2, 2014.
Eshhar, Z., "From the Mouse Cage to Human Therapy: A Personal Perspective of the Emergence of T-bodies/Chimeric Antigen Receptor T Cells," Human Gene Therapy, 25:773-778, Sep. 2014.
Frigault et al., "Identification of chimeric antigen receptors that mediate constitutive or inducible proliferation of T cells," Cancer Immunol Res, 3(4):356-367, Apr. 2015.
Galetto et al., "Pre-TCRα supports CD3-dependent reactivation and expansion of TCRα-deficient primary human T-cells," Molecular Therapy—Methods & Clinical Development, 1:14021, Jun. 11, 2014.
Goverman et al., "Chimeric immunoglobulin-T cell receptor proteins form functional receptors: implications for T for T cell receptor complex formation and activation," Cell, 60:929-939, Mar. 1990.
Gross et al., "Expression of immunoglobulin-T-cell receptor chimeric molecules as functional receptors with antibody-type specificity," Proc Natl Acad Sci U S A, 86(24):10024-10028, Dec. 1989.
Gross et al., "Endowing T cells with antibody specificity using chimeric T cell receptors," Faseb J, 6(15):3370-3378, Dec. 1, 1992.
Hart et al., "Retroviral transfer of a dominant TCR prevents surface expression of a large proportion of the endogenous TCR repertoire in human T cells," Gene Ther, 15(8):625-631, Feb. 28, 2008.
Karpanen et al., "T-cell receptor gene therapy ready to go viral?", Molecular Oncology, vol. 9, Issue 10, pp. 2019-2042, Dec. 2015.
Kuball et al., "Increasing functional avidity of TCR-redirected T cells by removing defined N-glycosylation sites in the TCR constant domain," J Exp Med, 206(2):463-475, Jan. 26, 2009.
Kuwana et al., "Expression of chimeric receptor composed of immunoglobulin-derived V regions and T-cell receptor-derived C regions," Biochem Biophys Res. Commun., 149(3):960-968, Dec. 31, 1987.
Long et al., "4-1BB costimulation ameliorates T cell exhaustion induced by tonic signaling of chimeric antigen receptors," Nature Medicine, 21(6):581-590, May 4, 2015.
Lustgarten et al., "Specific elimination of IgE production using T cell lines expressing chimeric T cell receptor genes," Eur J Immunol., 25(10):2985-2991, Oct. 1995.
Morgan et al., "Cancer regression and neurologic toxicity following anti-MAGEA3 TCR gene therapy," J Immunother., 36(2): 133-151, Feb. 2013.

Morris et al., "Optimizing T-cell receptor gene therapy for hematologic malignancies," Blood, vol. 127, No. 26, Jun. 30, 2016.
Osborn et al., "Evaluation of TCR Gene Editing Achieved by TALENs, CRISPR/Cas9, and megaTAL Nucleases," Molecular Therapy, vol. 24, No. 3, pp. 570-581, Mar. 2016.
Romeo et al., "Cellular immunity to HIV activated by CD4 fused to T cell or Fc receptor polypeptides," Cell, 64 (5):1037-46, Mar. 8, 1991.
Zhang et al., "Genetic engineering with T cell receptors", Adv. Drug Deliv. Rev., Jun. 1, 2012, 64(8): 756-762.
Allison et al., "Structure of a human gd T-cell antigen receptor," Nature, 411:820-824, 2001.
Haga-Friedman et al., "Incorporation of Transmembrane Hydrophobic Mutations in the TCR Enhance Its Surface Expression and T Cell Functional Avidity," J. of Immunol., 188:5538-5546, 2012.
Krshnan et al., "A conserved aB transmembrane interface forms the core of a compact T-cell receptor-CD3 structure within the membrane," Proc. Natl. Acad. Sci, USA, 113(43:E6649-E6658, Oct. 25, 2016.
Kuhns and Badgandi, "Piecing together the family portrait of TCR-CD3 complexes," Immunol. Rev., 250:120-143, 2012.
Wucherpfennig et al., "Structural Biology of the T-cell Receptor: Insights into Rceptor Assembly, Ligand Recognition, and Initiation of Signaling," Cold Spring Harb. Perspect. Biol., 2:a005140, 2009.
Altschul et al., "Basic Local Alignment Search Tool", Journal of Molecular Biology, vol. 215, pp. 403-410, 1990.
Altschul et al., "Gapped BLAST and PSI-BLAST: A New Generation of Protein Database Search Programs", Nucleic Acids Research, vol. 25, No. 17, pp. 3389-3402, 1997.
Aronovich et al., "The Sleeping Beauty transposon system: a non-viral vector for gene therapy", Human Molecular Genetics, vol. 20, Review, Issue 1, pp. R14-R20, 2011.
Barrett et al., "Treatment of advanced leukemia in mice with mRNA engineered T cells", Human Gene Therapy, vol. 22, No. 12, pp. 1575-1586, Dec. 2011.
Bell et al., "Preferential delivery of the Sleeping Beauty transposon system to livers of mice by hydrodynamic injection", Nat. Protoc., vol. 2, No. 12, 30 pages, 2007.
Brown et al., "Bioactivity and Safety of IL13Rα2-Redirected Chimeric Antigen Receptor CD8+ T Cells in Patients with Recurrent Glioblastoma", Clinical Cancer Research, vol. 21, No. 18, pp. 4062-4072, Sep. 15, 2015.
Carpenito et al., "Control of large, established tumor xenografts with genetically retargeted human T cells containing CD28 and CD137 domains", Proc Natl Acad Sci U S A, vol. 106, No. 9, pp. 3360-3365, 2009.
Chothia et al., "Canonical Structures for the Hypervariable Regions of Immunoglobulins", Journal of Molecular Biology, vol. 196, pp. 901-917, 1987.
Dao et al., "Targeting the Intracellular WT1 Oncogene Product with a Therapeutic Human Antibody", Sci. Transl. Med., vol. 5, No. 176, Mar. 13, 2013.
Ding et al., "Efficient Transposition of the piggyBac (PB) Transposon in Mammalian Cells and Mice", Cell, vol. 122, No. 3, pp. 473-483, Aug. 12, 2005.
Geysen et al., "Use of peptide synthesis to probe viral antigens for epitopes to a resolution of a single amino acid", Proc. Natl. Acad. Sci., vol. 81, pp. 3998-4002, Jul. 1984.
Grabundzija et al., "Comparative analysis of transposable element vector systems in human cells", Mol. Ther. Vol. 18, No. 6 pp. 1200-1209, Jun. 2010.
Grabundzija et al., "Sleeping Beauty transposon-based system for cellular reprogramming and targeted gene insertion in induced pluripotent stem cells", Nucleic Acids Res., vol. 41, No. 3, pp. 1829-1847, Feb. 2013.
Green et al., "Molecular Cloning", A Laboratory Manual 4th ed., Cold Spring Harbor Laboratory Press, Cold Spring Harbor, 5 pages, 2012.
Homyak et al., "Introduction to Nanoscience and Nanotechnology", CRC Press, 169 pages, 2008.
Hopp et al., "Prediction of protein antigenic determinants from amino acid sequences" Proc. Nati. Acad. Sci., vol. 78, No. 6, pp. 3824-3828, Jun. 1981.

(56) References Cited

OTHER PUBLICATIONS

Huang et al., "Sleeping Beauty Transposon-mediated Engineering of Human Primary T Cells for Therapy of CD19 +Lymphoid Malignancies", Mol. Therapy, vol. 16, pp. 580-589, 2008.

Jackson et al., "Driving CAR T-cells forward", Nat Rev Clin Oncol., vol. 13, No. 6, pp. 370-383, Jun. 2016.

Kabat et al., "Sequences of Proteins of Immunological Interest", U.S. Dept. of Health and Human Services, vol. 1, 1246 pages, 1991.

Kabat et al., "Unusual Distributions of Amino Acids in Complementarity-determining (Hypervariable) Segments of Heavy and Light Chains of Immunoglobulins and Their Possible Roles in Specificity of Antibody-combining Sites", Journal of Biological Chemistry, vol. 252, No. 19, pp. 6609-6616, Oct. 10, 1977.

Kebriaei et al. "First Clinical Trials Employing Sleeping Beauty Gene Transfer System and Artificial Antigen Presenting Cells to Generate and Infuse T Cells Expressing CD19-Specific Chimeric Antigen Receptor", Blood, vol. 122, Issue 21, 3 pages, Nov. 15, 2013.

Koneru et al., "A Phase I Clinical Trial of Adoptive T Cell Therapy Using IL-12 Secreting MUC-16ecto Directed Chimeric Antigen Receptors for Recurrent Ovarian Cancer", Journal of Translational Medicine, vol. 13, No. 102, pp. 1-11, 2015.

Kyte et al., "A simple method for displaying the hydropathic character of a protein", Journal of Molecular Biology, vol. 157, Issue 1, pp. 105-132, May 1982.

Liu et al., "Chimeric STAR receptors using TCR machinery mediate robust responses against solid tumors", Science Translational Medicine, vol. 13, No. 586, Mar. 24, 2021.

Iwai et al., "PD-1 blockade inhibits hematogenous spread of poorly immunogenic tumor cells by enhanced recruitment of effector T cells", International Immunology, vol. 17, No. 2, pp. 133-144, Feb. 2005.

Milone et al., "Chimeric Receptors Containing CD137 Signal Transduction Domains Mediate Enhanced Survival of T Cells and Increased Antileukemic Efficacy In Vivo", Molecular Therapy, vol. 17 No. 8, 1453-1464, Aug. 2009.

Myers et al., "Optimal alignments in linear space" Computer Application Bioscience, vol. 4, No., 1, pp. 11-17, 1988.

Needleman et al., "A general method applicable to the search for similarities in the amino acid sequence of two proteins", J. Mol. Biol. vol. 48, pp. 443-453, 1970.

Newick et al., "CAR T Cell Therapy for Solid Tumors", Annu. Rev. Med., vol. 68, pp. 139-152, Jan. 2017.

Pearson et al., "Improved tools for biological sequence comparison", Proc. Natl. Acad. Sci. USA, vol. 85, pp. 2444-2448, 1988.

Rafiq et al., "Engineering strategies to overcome the current roadblocks in CAR T cell therapy", Nature Reviews Clinical Oncology, vol. 17, No. 3, pp. 147-167, Mar. 2020.

Ruella et al., "Induction of resistance to chimeric antigen receptor T cell therapy by transduction of a single leukemic B cell", Nat Med., vol. 24, No. 10, pp. 1499-1503, Oct. 2018.

Sadelain et al., "The Basic Principles of Chimeric Antigen Receptor Design", Cancer Discovery, pp. 388-398, Apr. 2013.

Sastry et al., "Targeting hepatitis B virus-infected cells with a T-cell receptor-like antibody", Journal of Viralogy, vol. 85, No. 5, pp. 1935-1942, 2011.

Sergeeva et al., "An anti-PR1/HLA-A2 T-cell receptor-like antibody mediates complement-dependent cytotoxicity against acute myeloid leukemia progenitor cells", Immunobiology, Blood, vol. 117, No. 16, pp. 4262-4272, 2011.

Singh et al., "Redirecting specificity of T-cell populations for CD19 using the Sleeping Beauty system", Cancer Res., vol. 68, No. 8 pp. 2961-2971, Apr. 15, 2008.

Singleton, Paul., "Dictionary of DNA and Genome Technology", 3rd ed., Wiley Black well, 428 pages, Nov. 28, 2012.

Smith et al., "Comparison of biosequences", Advances in Applied Mathematics, vol. 2, pp. 482-489, 1981.

Smith et al., "Ex vivo expansion of human T cells for adoptive immunotherapy using the novel Xeno-free CTS Immune Cell Serum Replacement" Clinical & Translational Immunology, vol. 4, No. 1, e31, 10 pages, 2015.

Smith, Michael B., "March's Advanced Organic Chemistry Reactions, Mechanisms and Structure", 7th ed., J. Wiley & Sons, 9 pages, 2013.

Tokarew et al., "Teaching an old dog new tricks: next-generation CAR T cells", British Journal of Cancer, vol. 120, No. 1, pp. 26-37, Jan. 2019.

Torikai et al., "A foundation for universal T-cell based immunotherapy: T cells engineered to express a CD19-specific chimeric-antigen-receptor and eliminate expression of endogenous TCR", Blood, vol. 119, No. 24, 19 pages, Jun. 14, 2012.

Verma et al., "TCR Mimic Monoclonal Antibody Targets a Specific Peptide/HLA Class I Complex and Significantly Impedes Tumor Growth In Vivo Using Breast Cancer Models", Journal of Immunology, 2010, vol. 184, No. 4, pp. 2156-2165, 2010.

Willemsen et al., A phage display selected Fab fragment with MHC class I-restricted specificity for MAGE-A1 allows for retargeting of primary human T lymphocytes, Gene Therapy, vol. 8, No. 21, pp. 1601-1608, 2001.

Williams., "Sleeping Beauty Vector System Moves Toward Human Trials in the United States", Molecular Therapy, vol. 16, No. 9, pp. 1515-1516, Sep. 2008.

Wolchok et al., "Guidelines for the Evaluation of Immune Therapy Activity in Solid Tumors: Immune-Related Response Criteria", Clin. Cancer Res., vol. 15, No. 23, pp. 7412-7420, Dec. 1, 2009.

Zhao et al., "High-Efficiency Transfection of Primary Human and Mouse T Lymphocytes Using RNA Electroporation", Molecular Therapy, vol. 13, No. 1, 18 pages, Jan. 2006.

Maher et al., "Human T-Lymphocyte Cytotoxicity and Proliferation Directed by a Single Chimeric TCR$\zeta$/CD28 Receptor", Nature Biotechnology, vol. 20, Jan. 2002, pp. 70-75.

\* cited by examiner

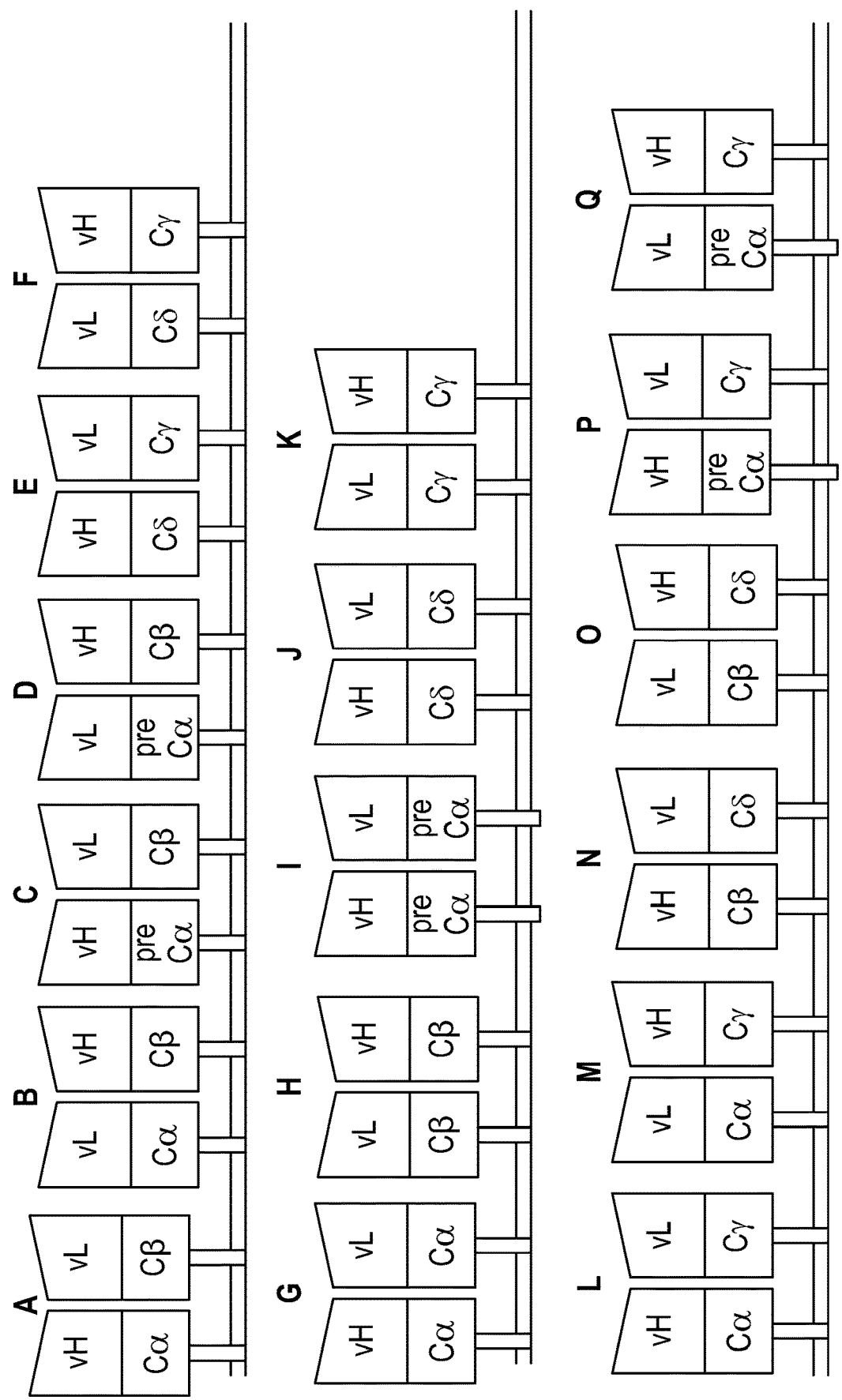
FIG. 3A-Q

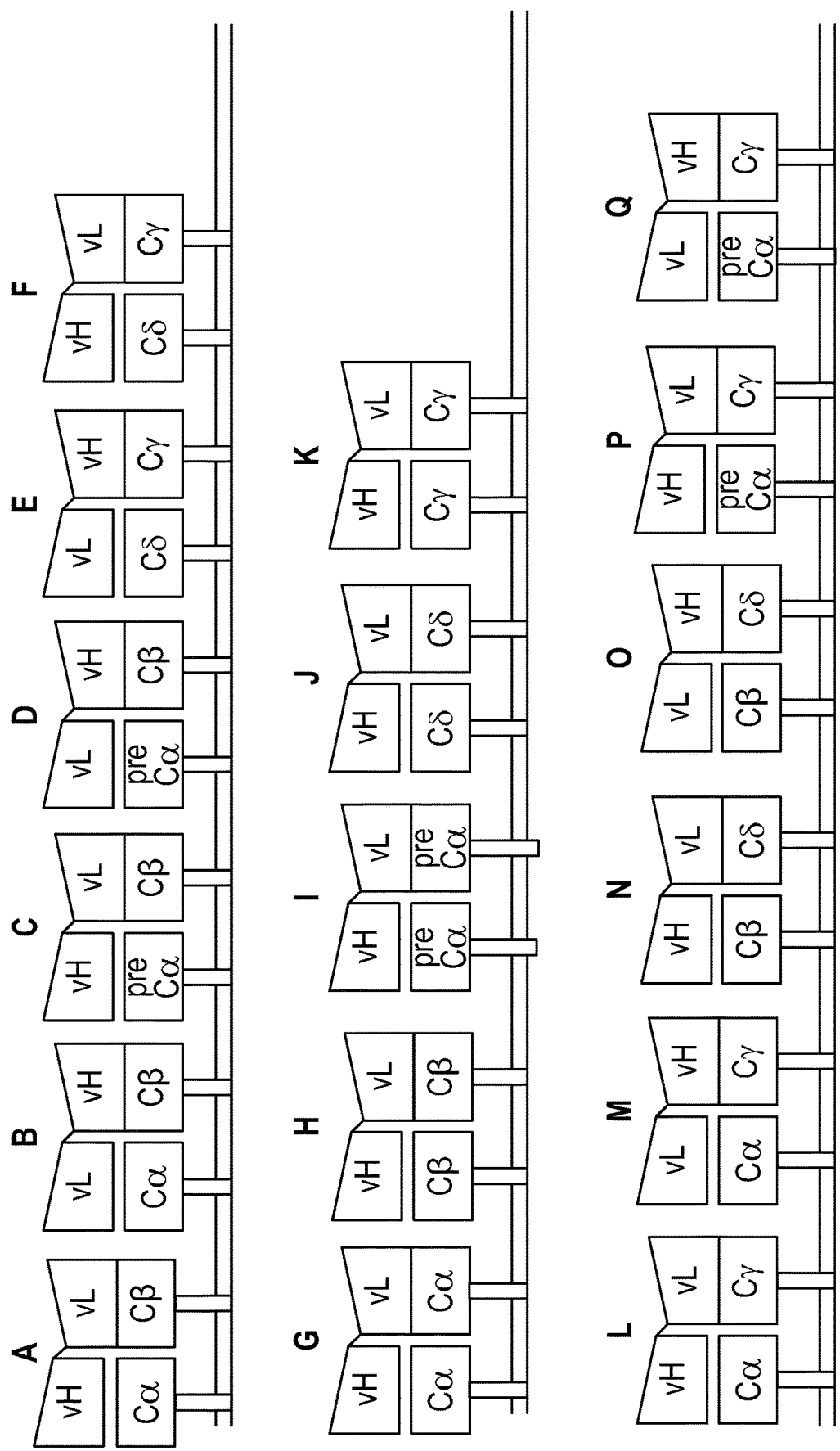
FIG. 4A-Q

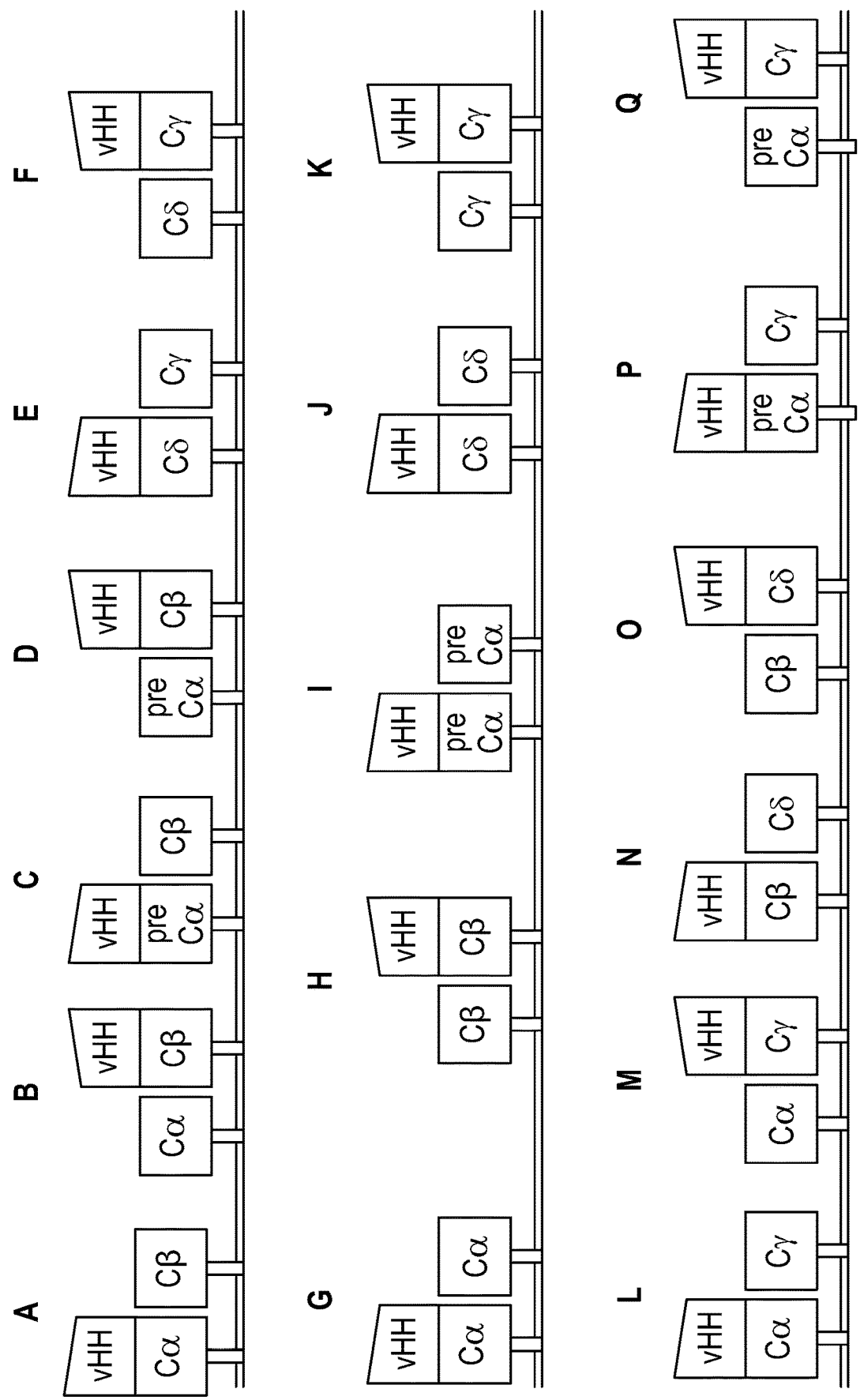
FIG. 5A-Q

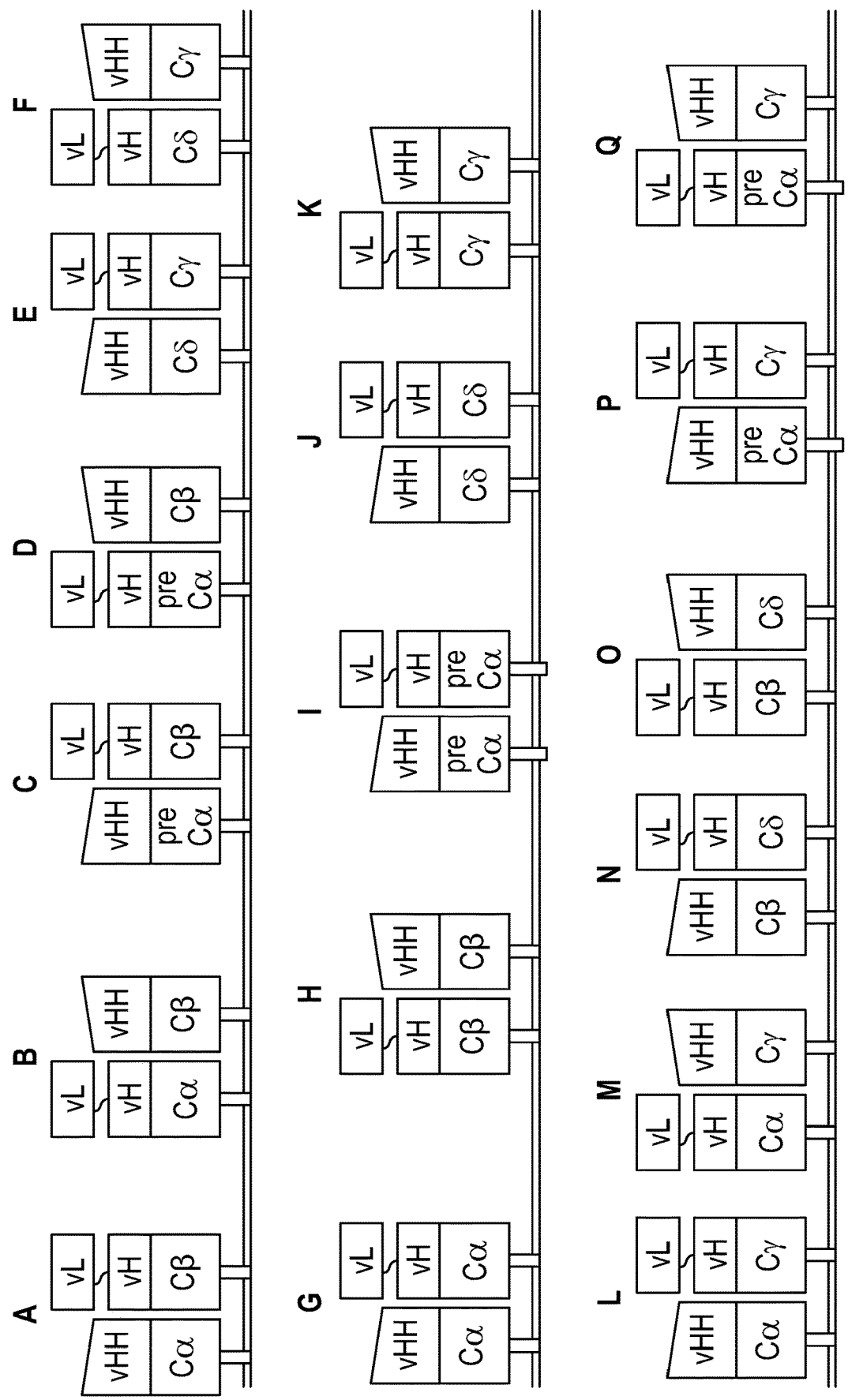
FIG. 6A-Q

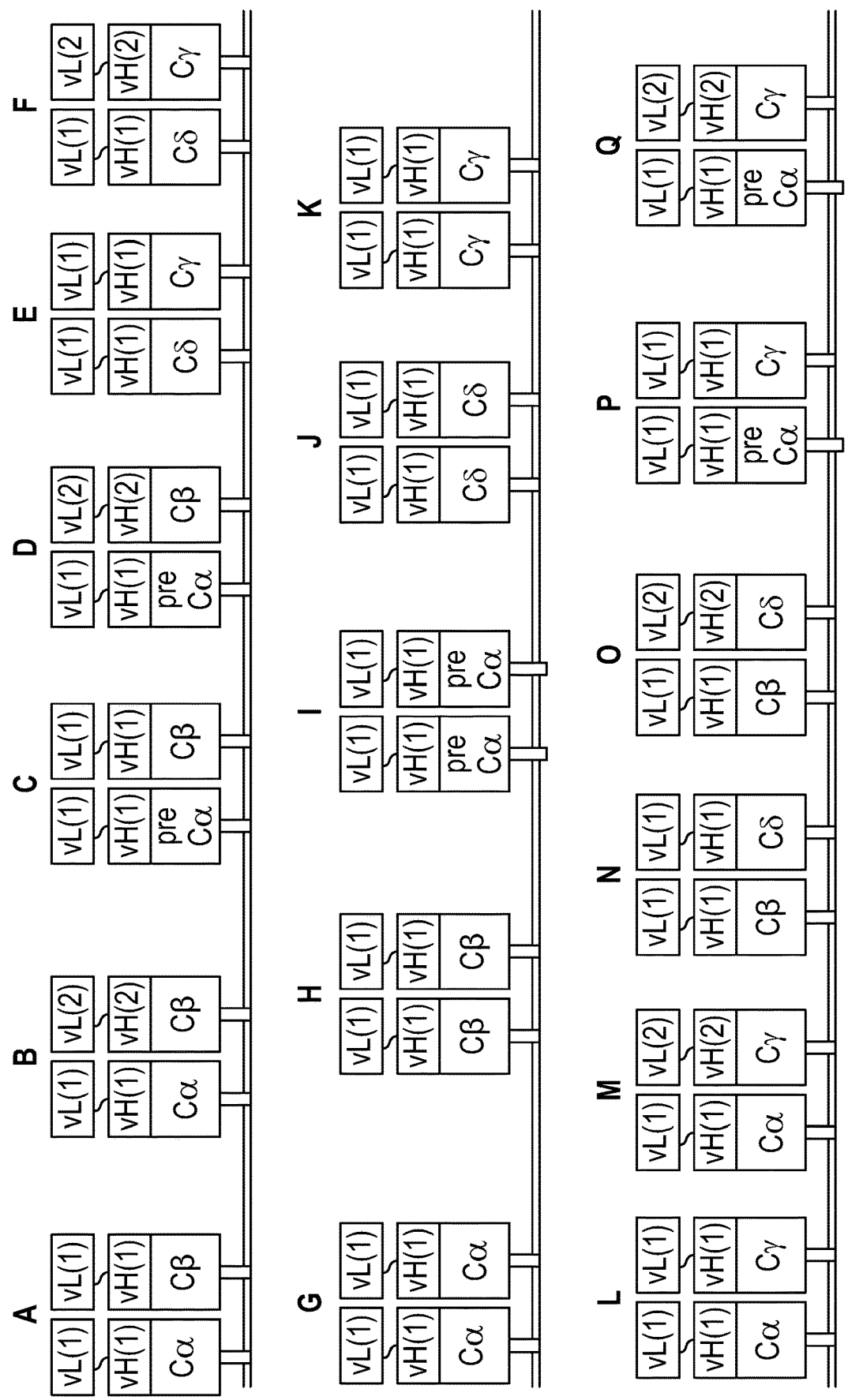
FIG. 7A-Q

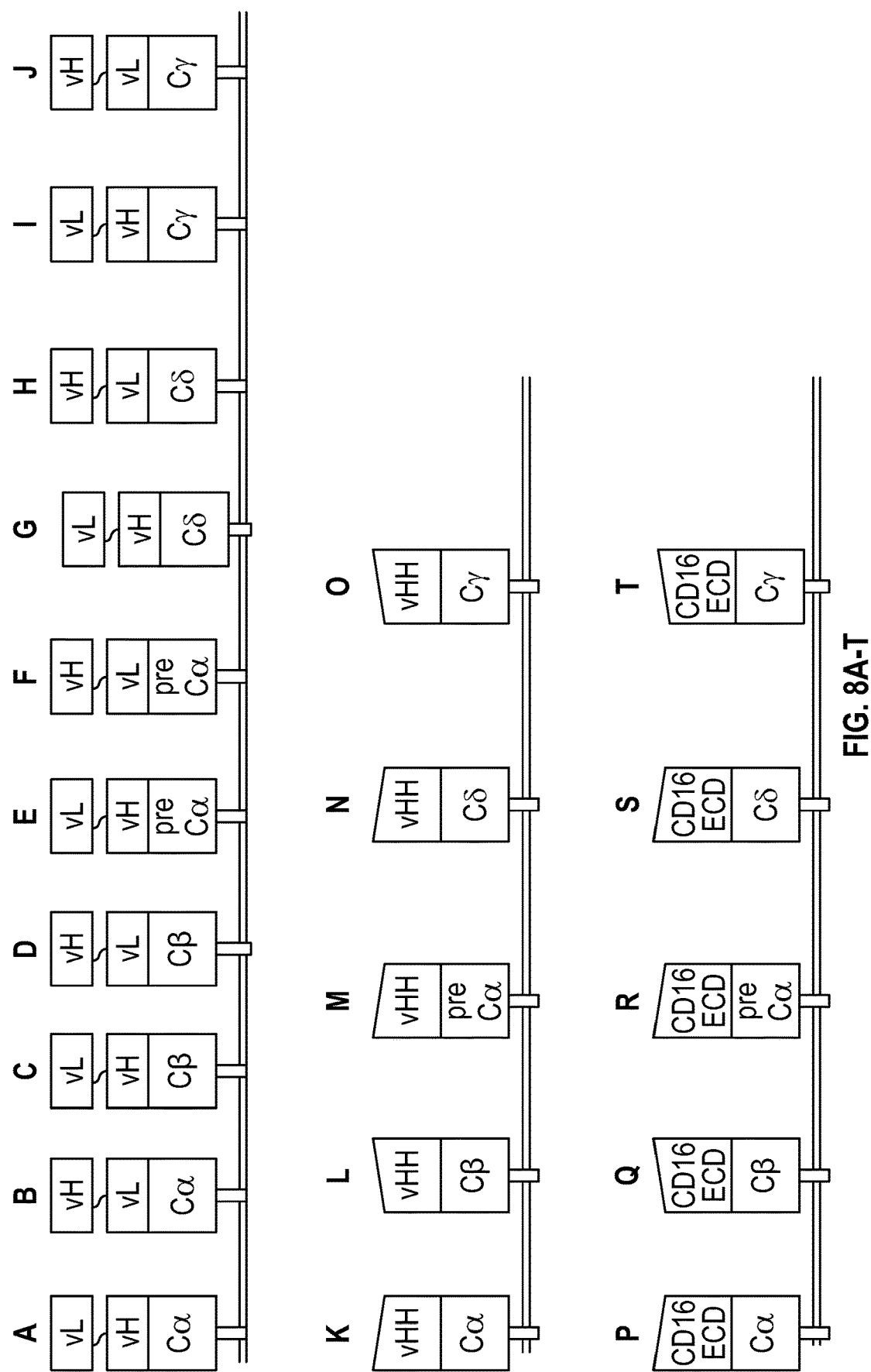
FIG. 8A-T

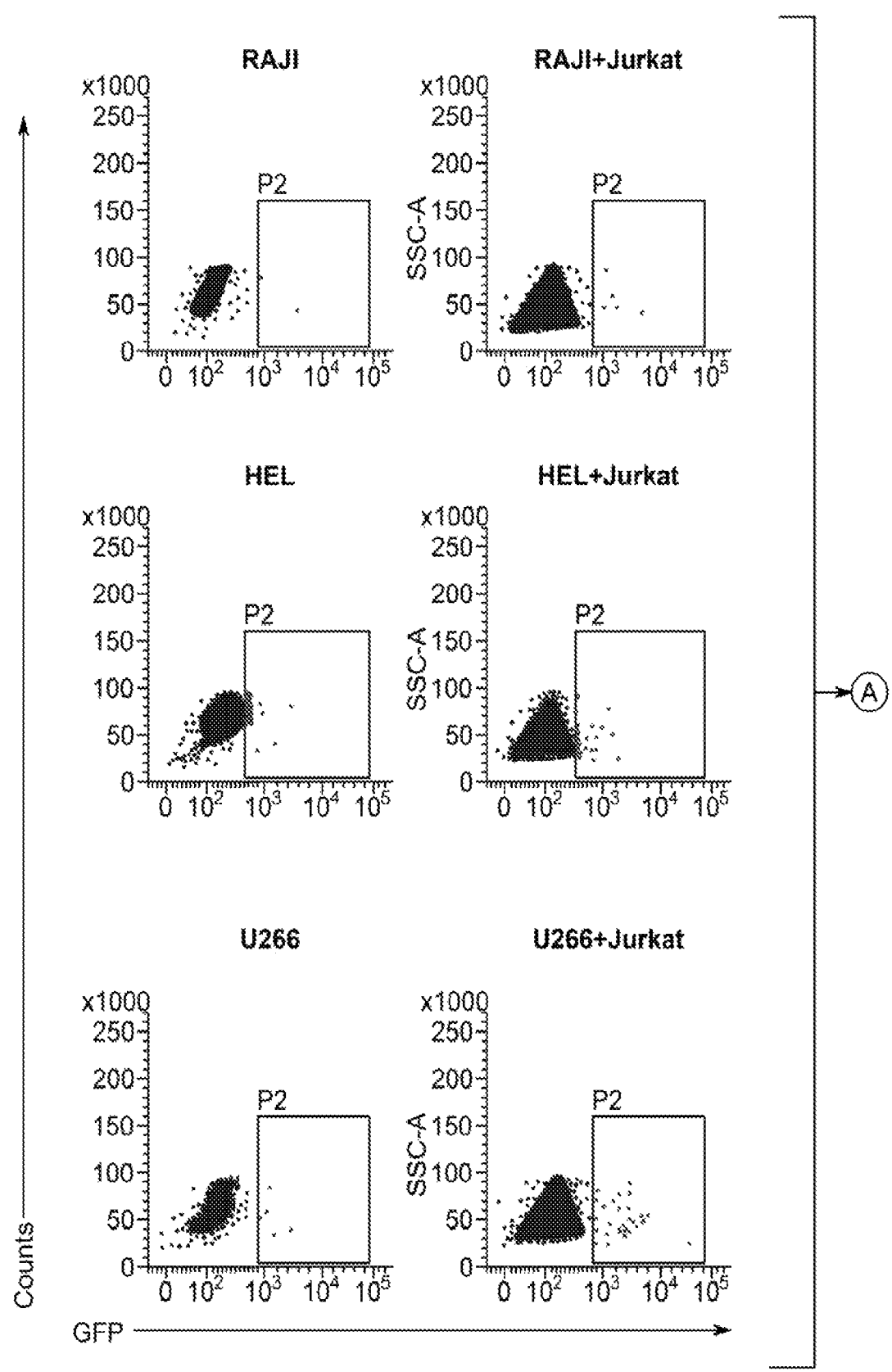
FIG. 13A-A

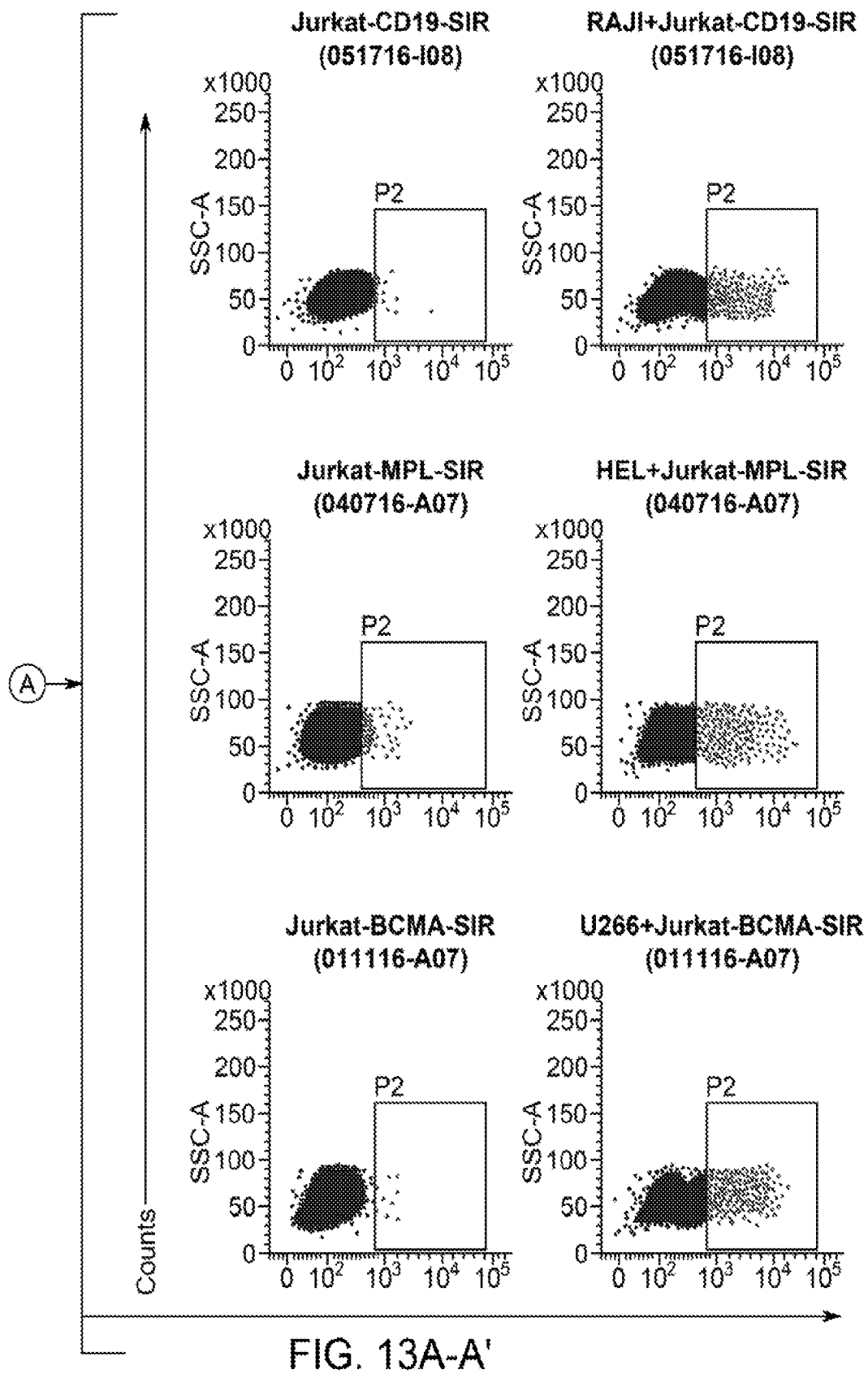
FIG. 13A-A'

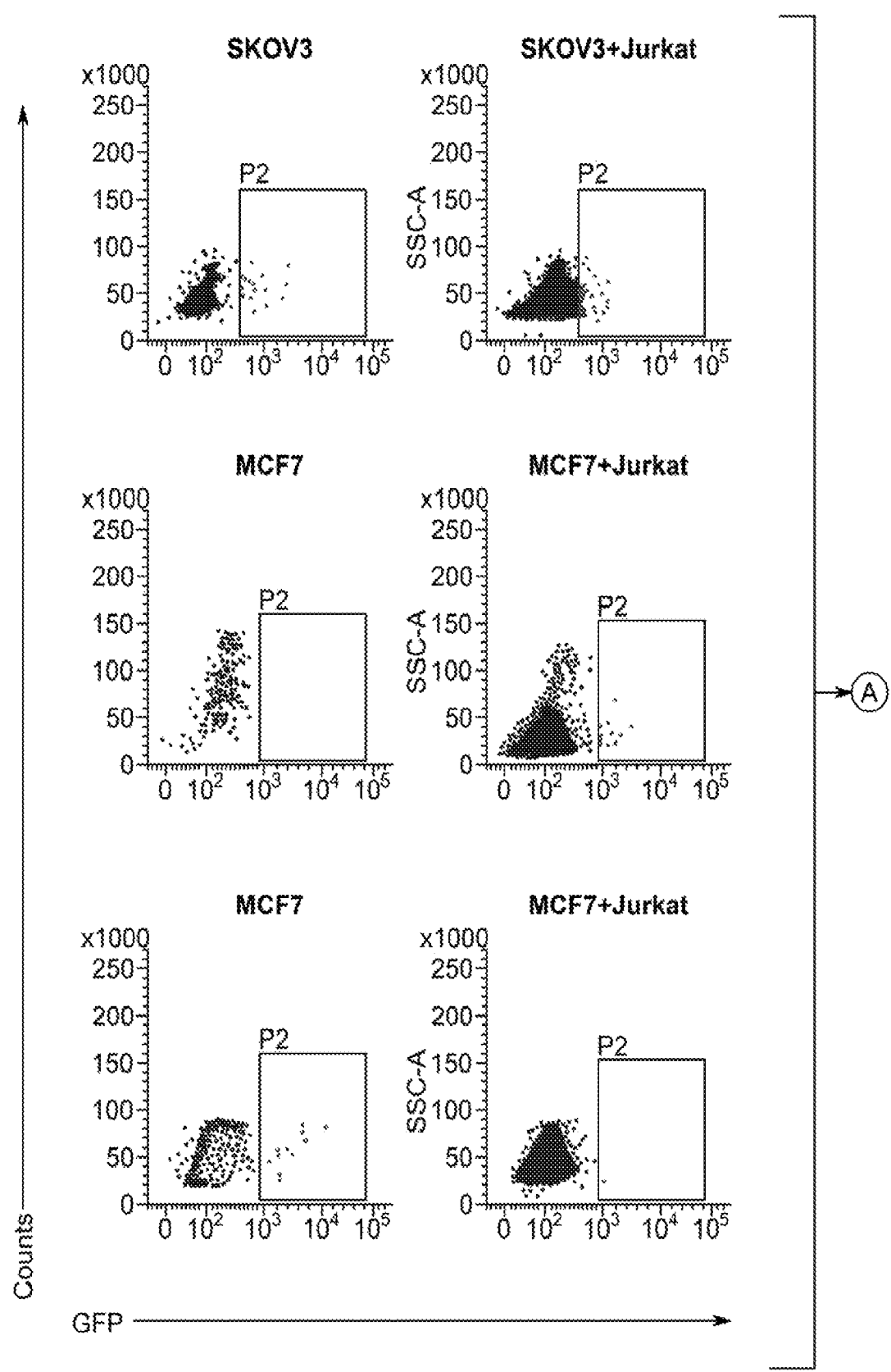
FIG. 13B-B

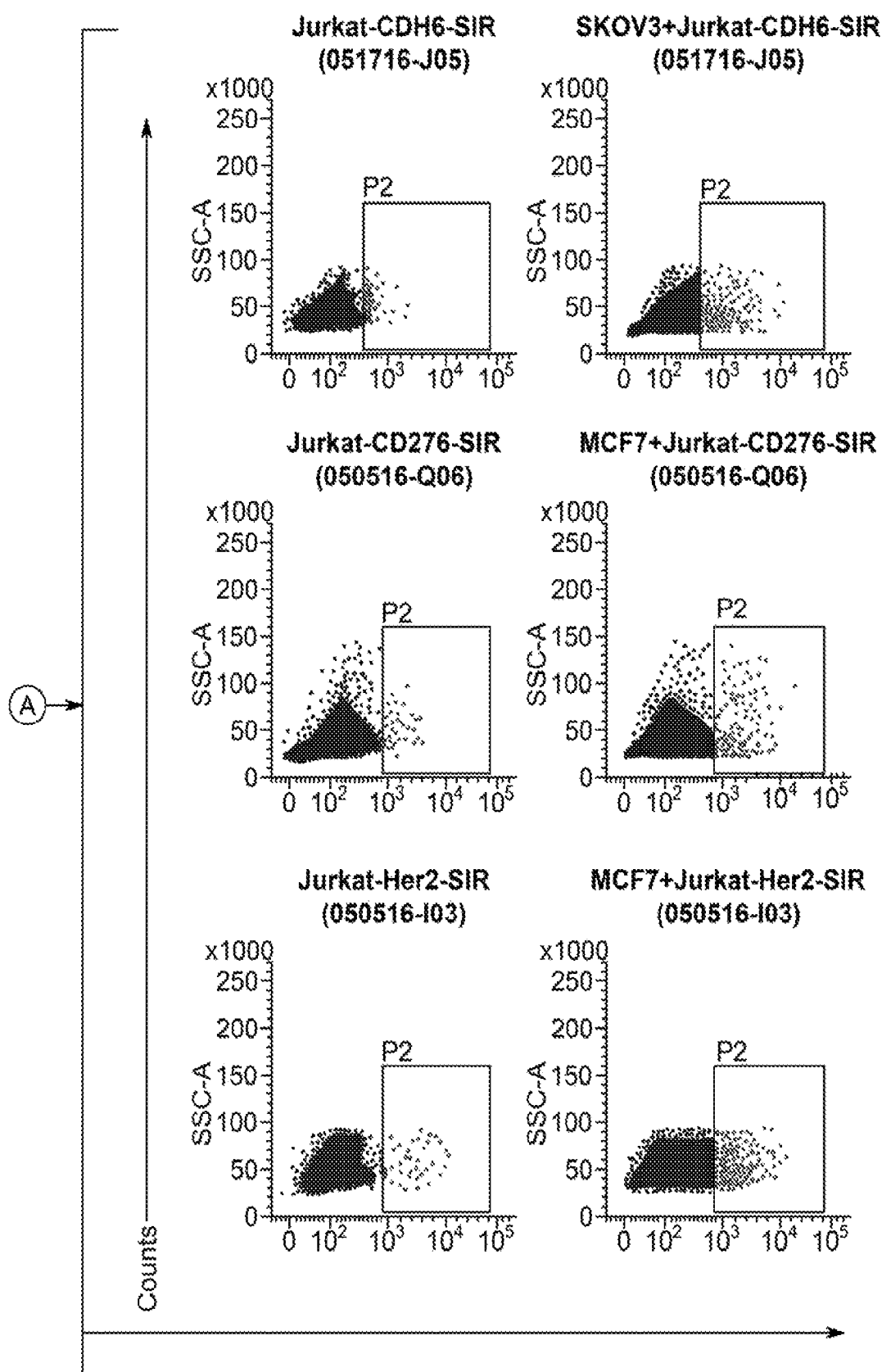
FIG. 13B-B'

Protein L: 293-pLenti-EF1-Nhe-IgHSP-ECoR1-ProLII-BstB1-ProLII-Mlu-Myc-CD8-BBz-XS-T2A-PAC-K01(072716-K01)

Protein L: 293-pLenti-EF1-Nhe-IgHSP-ECoR1-ProLII-BstB1-ProLII-Mlu-Myc-CD8-BBz-XS-T2A-PAC-K01(072716-K01)

Jurkat-NFAT-eGFP
CD8SP-HuLuc64-vL-V5-[hTCRb-KACIAH]-F-P2A-
SP-HuLuc64-vH-Myc-[hTCRa-CSDVP]-F-F2A-PAC
(092916-E07)(SEQ ID: 1253)

Protein L: 293-pLenti-EF1-Nhe-IgHSP-ECoR1-ProLll-BstB1-ProLll-Mlu-Myc-
CD8-BBz-XS-T2A-PAC-K01(072716-K01)

Jurkat-NFAT-eGFP
CD8SP-V5-[hTCRb-KACIAH]-F-P2A-CD8SP-
CD19Bu12-vL-Gly-Ser-Linker-CD19Bu12-vH-Myc
[hTCRa-CSDVP]-F-F2A-PAC (082815-E05)(SEQ ID: 1622)

Protein L: 293-pLenti-EF1-Nhe-IgHSP-ECoR1-ProLll-BstB1-ProLll-Mlu-Myc-
CD8-BBz-XS-T2A-PAC-K01(072716-K01)

SYNTHETIC IMMUNE RECEPTORS AND METHODS OF USE THEREOF

CROSS REFERENCE TO RELATED APPLICATIONS

The application is a U.S. National Stage Application filed under 35 U.S.C. § 371 and claims priority to International Application No. PCT/US2017/064379, filed Dec. 2, 2017, which application claims priority under 35 U.S.C. § 119 to U.S. Provisional Application Ser. No. 62/429,619, filed Dec. 2, 2016 and U.S. Provisional Application No. 62/429,597, filed Dec. 2, 2016, the disclosures of which are incorporated herein by reference.

STATEMENT REGARDING FEDERALLY SPONSORED RESEARCH OR DEVELOPMENT

This invention was made with government support under Grant No. 1R01DE025804-01 awarded by National Institutes of Health. The government has certain rights in the invention.

TECHNICAL FIELD

The invention involves synthetic immune receptor (SIR) polypeptides, polynucleotides, expression constructs and the use of immune effector cells (e.g. T cells, NKT cells) and stem cells engineered to express a synthetic immune receptor (SIR). The disclosure also provides methods of using such polypeptides, polynucleotides, expression constructs and recombinant cells for treating diseases and disorders including, but not limited to, cancer, infectious disease, allergic disease, autoimmune disease, degenerative disease or combination of the above.

INCORPORATION BY REFERENCE OF SEQUENCE LISTING

Accompanying this filing is a Sequence Listing entitled "Sequence-Listing.txt", created on Aug. 19, 2019 and having 77,085,230 bytes of data, machine formatted on IBM-PC, MS-Windows operating system. The sequence listing is hereby incorporated herein by reference in its entirety for all purposes.

BACKGROUND

Strategies that activate the immune cells to selectively recognize and destroy tumors, namely cancer immunotherapy offers a powerful approach to cancer therapy. Immunotherapy using adoptive transfer of tumor-specific T cells and chimeric antigen receptor (CAR) modified T cells (CAR-T cells) mediates durable and complete disease regression in some patients with metastatic cancer.

Despite the success with CAR-T cells, there are several limitation to this approach. In majority of patients who respond to engineered CAR-T cells, excessive release of proinflammatory cytokines causes symptoms that include fevers, hypotension, hypoxemia, cardiac dysfunction, kidney failure and electrolyte abnormalities, collectively termed as "cytokine release syndrome' (CRS). In some cases, CAR therapy can lead to neurologic symptoms including tremor, seizures and can be fatal. Strategies to counteract CRS include treatment with immunosuppressive agents and antibodies to cytokines to block cytokine release.

In addition, one of the most important challenges of successful cancer immunotherapy is for the genetically modified T cells to persist beyond a few months after transfer. This has proved to be a greater challenge for T cells modified with CAR genes.

Recent molecular engineering of CAR constructs to include the co-stimulatory domains CD28 or 41BB have resulted in improved persistence. However, inclusion of costimulatory domain in the CAR construct results in non-physiological signaling through the receptor. Some CARs show tonic antigen-independent signaling, which leads to unrestrained cellular activation, eventually resulting in apoptosis, excessive cytokine release independent of cognate antigens, and immunologic exhaustion. Expression of some CARs containing CD28 and CD3z tandem signaling domains leads to constitutive activation and proliferation of the transduced primary human T cells which was related to inferior in vivo efficacy (Frigault et al., 2015). One mechanism that was found to result in the phenotype of CARs with continuous T-cell proliferation was high density of CARs at the cell surface (Frigault et al., 2015).

T cell receptors (TCR) are expressed on the surface of T cells. In humans, these receptors recognize complexes formed between human leukocyte antigen (HLA) molecules and antigenic peptides. Recognition of these peptides results in activation of the T-cell's immune functions.

In most T cells, the TCR is a heterodimer of an alpha (α) and a beta (β) chain. The β chain has two isoforms: Cβ2 (in 80% of human T cells) and Cβ1 (in 20% of human T cells). Each chain of the TCR comprises an N-terminal immunoglobulin (Ig)-like variable (V) domain and an Ig-like constant (C) domain, which in turn comprises a transmembrane region and a short cytoplasmic tail at the C-terminus.

SUMMARY

The disclosure provides for at least one recombinant polynucleotide encoding at least one synthetic immune receptor (SIR), the at least one SIR comprising (a) a T-cell receptor (TCR) constant chain having an amino acid sequence selected from the group consisting of: (i) an amino acid sequence that is at least 98% identical to SEQ ID NO:3010 and has one or more mutations at positions 48, 61, 91, 92, 93, and/or 94 and which may comprise an optional accessory module; (ii) an amino acid sequence that is at least 98% identical to SEQ ID NO:3024 and has one or more mutations at positions 18, 22, 57, 79, 133, 136 and/or 139 and which may comprise an optional accessory module; (iii) an amino acid sequence that is at least 98% identical to SEQ ID NO:3025 and has one or more mutations at position 18, 22, 57, 79, 133, 136 and/or 139 and which may comprise an optional accessory module; (iv) an amino acid sequence that is at least 98% identical to SEQ ID NO:3046, 3047 or 3048 and which may comprise an optional accessory module; (v) an amino acid sequence that is at least 98% identical to SEQ ID NO:3049 and which may comprise an optional accessory module; (vi) an amino acid sequence that is at least 98% identical to SEQ ID NO:3051 or 3052 and which may comprise an optional accessory module; and (vii) a dimer combination of two TCR constant chains selected from (i) and (ii), (i) and (iii), (iv) and (ii), (iv) and (iii), and (v) and (vi); (b) an optional linker; and (c) one or more non-natural TCR antigen binding domain(s) linked to (a) selected from the group consisting of: (1) an antibody; (2) an antibody fragment (e.g. a Fv, a Fab, a (Fab')2); (3) a heavy chain variable region of an antibody (vH domain) or a fragment thereof, (4) a light chain variable region of an antibody (vL domain) or a fragment thereof, (5) a single chain variable fragment (scFv) or a fragment thereof, (6) a single domain antibody (SDAB) or a fragment thereof, (7) a camelid VHH domain or a fragment thereof, (8) a monomeric variable region of an antibody; (9) a non-immunoglobulin antigen binding scaffold such as a DARPIN, an affibody, an affilin, an adnectin, an affitin, an obodies, a repebody, a fynomer, an alphabody, an avimer, an atrimer, a centyrin, a pronectin, an anticalin, a kunitz domain, an Armadillo repeat protein or a fragment thereof; (10) a receptor or a fragment thereof; (11) a ligand or a fragment thereof, (12) a bispecific-antibody, -antibody fragment, -scFV, -vHH, -SDAB, -non-immunoglobulin antigen binding scaffold, -receptor or -ligand; and (13) an autoantigen or a fragment thereof, wherein the mutations of (a)(i)-(a)(iii) and the dimer of (a)(vii) provide a diverse binding affinity to a target antigen of the antigen binding domain and that is at least 5% greater than the binding affinity of a cTCR having the same binding domain and which synthetic immune receptor, upon expression in a lymphocyte, expresses both said antigen binding domain and said T cell receptor constant chain in one or more continuous chains on the surface of the lymphocytes such that lymphocytes are triggered to activate, proliferate, secrete cytokines and/or modulate (induce or suppress) killing of the target cells and have MHC-restricted and MHC-non-restricted antibody-type specificity when said expressed antigen binding domain binds to its antigen. In one embodiment, comprising TCR constant chains of (a)(vii) the non-natural TCR binding domains is selected from the group consisting of: variable regions of a heavy and light chains of an antibody or fragments thereof specific for a predefined target antigen, such that, when expressed, one of said heavy and light chains of the antibody or fragments thereof is attached to one of said two chains of (a)(vii) of said T-cell constant region and the other of said heavy and light chains of the antibody or fragments thereof is attached to the other of said two chains of said T-cell constant regions; two single chain variable fragments (scFv) specific for one or more predefined target antigens, such that, when expressed, one of said scFv is attached to one of said two chains of (a)(vii) of said T-cell constant region and the other of said scFv is attached to the other of said two chains of said T-cell constant regions; two antibody fragment specific for one or more predefined target antigens, such that, when expressed, one of said antibody fragments is attached to one of said two chains of (a)(vii) of said T-cell constant region and the other of said antibody fragments is attached to the other of said two chains of said T-cell constant regions; two single domain antibody (SDAB) fragments specific for one or more predefined target antigens, such that, when expressed, one of said SDAB fragments is attached to one of said two chains of (a)(vii) of said T-cell constant region and the other of SDAB fragments is attached to the other of said two chains of said T-cell constant regions; two camelid vHH domains specific for one or more predefined target antigens, such that, when expressed, one of said vHH domains is attached to one of said two chains of (a)(vii) of said T-cell constant region and the other of vHH domains is attached to the other of said two chains of said T-cell constant regions; two non-immunoglobulin antigen binding scaffolds specific for one or more predefined target antigens, such that, when expressed, one of said non-immunoglobulin antigen binding scaffolds is attached to one of (a)(vii) of said two chains of said T-cell constant region and the other of said non-immunoglobulin antigen binding scaffolds domains is attached to the other of said two chains of said T-cell constant regions; two receptors or a fragment thereof specific for one or more predefined target antigens, such that, when expressed, one of said receptors or a fragment thereof is attached to one of said two chains of (a)(vii) of said T-cell constant region and the other of said receptors or a fragment thereof is attached to the other of said two chains of said T-cell constant regions; two ligands or a fragment thereof specific for one or more predefined target antigens, such that, when expressed, one of said ligands or a fragment thereof is attached to one of said two chains of (a)(vii) of said T-cell constant region and the other of said ligands or a fragment thereof is attached to the other of said two chains of said T-cell constant regions; two structurally distinct antigen binding fragments specific for one or more predefined target antigens, such that, when expressed, one of said antigen binding fragments is attached to one of (a)(vii) of said two chains of said T-cell constant region and the other of said antigen binding fragments is attached to the other of said two chains of said T-cell constant regions; two binding fragments one or both of which are bispecific or multispecific such that, when expressed, one of said antigen binding fragments is attached to one of said two chains of (a)(vii) of said T-cell constant region and the other of said antigen binding fragments is attached to the other of said two chains of said T-cell constant regions; two autoantigens or fragment thereof, such that, when expressed, one of said autoantigens or fragments thereof is attached to one of (a)(vii) of said two chains of said T-cell constant region and the other of said autoantigens or fragments thereof is attached to the other of said two chains of said T-cell constant regions; and two vL or fragment thereof, such that, when expressed, one of said vL or fragments thereof is attached to one of (a)(vii) of said two chains of said T-cell constant region and the other of said vL or fragments thereof is attached to the other of said two chains of said T-cell constant regions; and two vH or fragment thereof, such that, when expressed, one of said vH or fragments thereof is attached to one of (a)(vii) of said two chains of said T-cell constant region and the other of said vH or fragments thereof is attached to the other of said two chains of said T-cell constant regions. In yet another or further embodiment of any of the foregoing, the TCR constant chains of (a)(iv) has a non-natural TCR binding domains selected from the group consisting of the variable region of the heavy chain (vH) of an antibody or a fragment thereof specific for a predefined target antigen; the variable region of the light chain (vL) of an antibody or a fragment thereof specific for a predefined target antigen; a single chain variable fragment (scFv) or a fragment thereof specific for a predefined target antigens; an antibody fragment (e.g., Fv, a Fab, a (Fab')2) specific for a predefined target antigen; a single domain antibody (SDAB) fragments specific for a predefined target antigen; a camelid vHH domain specific for a predefined target antigen; a non-immunoglobulin antigen binding scaffolds specific for a predefined target antigen; a receptors specific or a fragment thereof for a predefined target antigen; a ligands or a fragment thereof specific for a predefined target antigens; a bispecific-antibody, -antibody fragment, -scFV, -vHH, -SDAB, -non-immunoglobulin antigen binding scaffold, -receptor or -ligand specific for one or more predefined target antigens; and an autoantigen or a fragment thereof. In yet another embodiment, a polynucleotide encoding for (i), (ii), (iii), (iv), (v), or (vi), the non-natural TCR binding domains is selected from the group consisting of a variable region of the heavy chain (vH) of an antibody specific for the predefined target antigen; a variable region of the light chain (vL) of an antibody specific for the predefined target antigen; a single chain variable fragment (scFv) specific for a predefined target antigens; an antibody fragment (e.g., Fv, a Fab, a (Fab')2) specific for a predefined target antigen; a single domain antibody (SDAB) fragments specific for a predefined target antigen; a camelid vHH domains specific for a predefined target antigen; a non-immunoglobulin antigen binding scaffolds specific for a predefined target antigen; a receptors specific for a predefined target antigen or fragments thereof; a ligands specific for a predefined target antigens or fragments thereof; a bispecific-antibody, -antibody fragment, -scFV, -vHH, -SDAB, -non-immunoglobulin antigen binding scaffold, -receptor or -ligand specific for one or more predefined target antigens; and an autoantigen or a fragment thereof. In another or further embodiment of any of the foregoing, the polynucleotide encoding the TCR constant chain is a codon-optimized sequences. In another or further embodiment of any of the foregoing, the polynucleotide encoding the TCR constant chain of (a) encodes a TCR constant chain(s) comprising mutations that enhance the expression and/or pairing of TCR constant chains and reduce their pairing with the endogenous T cell receptor chains. In another or further embodiment of any of the foregoing, the polynucleotide encoding the TCR constant chain of (a) comprises a nucleic acid sequence of 1-40 modifications of a nucleic acid sequence of SEQ ID NO: 730 to 743 or a sequence with at least 70% identity to a nucleic acid sequences of SEQ ID NO: 730 to 743, and which is capable of dimerizing with a TCRβ1 or TCRβ2 chain. In another or further embodiment of any of the foregoing, the polynucleotide encoding the TCR constant chain of (b) or (c) comprises a nucleic acid sequence of 1-40 modifications of a nucleic acid sequence of SEQ ID NO: 744 to 765 or a sequence with at least 70% identity to a nucleic acid sequences of SEQ ID NO: 744 to 765 and which is capable of dimerizing with a TCRα chain. In another or further embodiment of any of the foregoing, the polynucleotide encoding the TCR constant chain of (v) comprises a nucleic acid sequence of 1-40 modifications of a nucleic acid sequence of SEQ ID NO: 769 to 770 or a sequence with at least 70% identity to an nucleic acid sequences of SEQ ID NO: 769 to 770 and which is capable of pairing with a TCRδ chain. In another or further embodiment of any of the foregoing, the polynucleotide encoding the TCR constant chain of (vi) comprises a nucleic acid sequence of 1-40 modifications of a nucleic acid sequence of SEQ ID NO: 771 to 772 or a sequence with at least 70% identity to a nucleic acid sequences of SEQ ID NO: 771 to 772 and which is capable of dimerizing with a TCRγ chain. In another or further embodiment of any of the foregoing, the polynucleotide encoding the TCR constant chain of (iv) comprises a nucleic acid sequence of 1-40 modifications of a nucleic acid sequence of SEQ ID NO: 766 to 768 or a sequence with at least 70% identity to a nucleic acid sequences of SEQ ID NO: 766 to 768 and which is capable of dimerizing with a TCRβ1 or TCRβ2 chain. In another or further embodiment of any of the foregoing, said one or more non-natural TCR antigen binding domain(s) bind to one or more of disease-associated antigens are selected from a group consisting of: CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8) aNeu5Ac(2-3)bDGalp(1-4)bDGlcp(l-1)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); Fms Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-llRa); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDClalp(l-4) bDGlcp(l-1)Cer); transglutaminase 5 (TGS5); high molecular weight-melanoma associated antigen (HMW-MAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGEl); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCT A-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B 1 (CYPlB 1); CCCTC-Binding Factor (Zinc Finger Protein)-Like (BORIS or Brother of the Regulator of lmprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen) Fucosyl-GM1, PTK7, gpNMB, CDH1-CD324, DLL3, CD276/B7H3, IL11Ra, IL13Ra2, CD179b-IGL11, ALK TCR gamma-delta, NKG2D, CD32 (FCGR2A), Tn ag, CSPG4-HMW-MAA, Tim1-/HVCR1, CSF2RA (GM-CSFR-alpha), TGFbetaR2, VEGFR2/KDR, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Chorionic Gonadotropin Hormone receptor (CGHR), CCR4, GD3, SLAMF6, SLAMF4, HIV1 envelope glycoprotein, HTLV1-Tax, CMV pp65, EBV-EBNA3c, influenza A hemagglutinin (HA), GAD, PDL1, Guanylyl cyclase C (GCC), KSHV-K8.1 protein, KSHV-gH protein, auto antibody to desmoglein 3 (Dsg3), autoantibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IGE, CD99, RAS G12V, Tissue Factor 1 (TF1), AFP, GPRC5D, claudin18.2 (CLD18A2 OR CLDN18A.2)), P-glycoprotein, STEAP1, LIV1, NECTIN-4, CRIPTO, GPA33, BST1/CD157, low conductance chloride channel, and antigen recognized by TNT antibody. In another or further embodiment of any of the foregoing, said one or more non-natural TCR antigen binding domain(s) comprises an antibody, an antibody fragment, an scFv, a Fv, a Fab, a (Fab')2, a single domain antibody (SDAB), a vH or vL domain, a camelid vHH domain, a non-immunoglobulin antigen binding scaffolds such as DARPINs, affibodies, affilins, adnectins, affitins, obodies, repebodies, fynomers, alphabodies, avimers, atrimers, centyrins, pronectins, anticalins, kunitz domains, Armadillo repeat proteins, a receptor or a ligand. In another or further embodiment of any of the foregoing, said one or more non-natural TCR antigen binding domain(s) is selected from the group consisting of: (i) a heavy chain variable region (vH) encoded by a polynucleotide having a sequence of any one of SEQ ID NO 226 to 400 or 10203 to 10321 or sequences with at least 98% identity thereto and which encodes a polypeptide the binds to its antigen; (ii) a light chain variable region (vL) encoded by a polynucleotide having a sequence of any one of SEQ ID NO 16 to 191 or 10085 to 10202 or sequences with at least 98% identity thereto and which encodes a polypeptide the binds to its antigen; (iii) a single chain variable fragment (scFv) encoded by a polynucleotide having a sequence of any one of SEQ ID NO 488 to 657, 10346 to 10400 or 18098 to 18160 or sequences with at least 98% identity thereto and which encodes a polypeptide the binds to its antigen; (iv) a camelid VHH domain encoded by a polynucleotide having a sequence of any one of SEQ ID NO 421 to 445 or 10322 to 10337 or sequences with at least 98% identity thereto and which encodes a polypeptide the binds to its antigen; (v) a non-immunoglobulin scaffold encoded by a polynucleotide having a sequence of any one of SEQ ID NO 439 to 443 or sequences with at least 98% identity thereto and which encodes a polypeptide the binds to its antigen; (vi) a receptor encoded by a polynucleotide having a sequence of any one of SEQ ID NO 456 to 468 or sequences with at least 98% identity thereto and which encodes a polypeptide the binds to its cognate; and (vii) a ligand encoded by a polynucleotide having a sequence of any one of SEQ ID NO 476 to 486 or 10402 to 10404 or sequences with at least 98% identity thereto and which encodes a polypeptide the binds to its cognate. In another or further embodiment of any of the foregoing, said one or more non-natural TCR antigen binding domain(s) comprise one or more of light chain complementary determining region for a selected target antigen as set forth in any of SEQ ID Nos: 13999 to 14879 or 14880 and/or one or more of heavy chain complementary determining region for a selected target antigen as set forth in any of SEQ ID Nos:14881 to 15761 or 15762. In another or further embodiment of any of the foregoing, said one or more non-natural TCR antigen binding domain(s) comprises a variable light (vL) domain comprising a sequence of any one of SEQ ID Nos:2307 to 2482 or 12042 to 12159 having up to 10 conservative amino acid substitutions and/or a variable heavy (vH) domain comprising a sequence of any one of SEQ ID Nos:2506 to 2680 or 12160 to 12278 having up to 10 conservative amino acid substitutions. In another or further embodiment of any of the foregoing, said one or more non-natural TCR antigen binding domain(s) comprises one or more of camelid vHH complementary determining regions for a selected antigen as set forth in any of SEQ ID Nos:2701 to 2725 or 12279 to 12294 having up to 10 conservative amino acid substitutions. In another or further embodiment of any of the foregoing, said one or more non-natural TCR antigen binding domain(s) comprises a non-immunoglobulin antigen binding domains having a sequence as set forth in any of SEQ ID NOs: 2728-2732 or 12296 to 12301 and having up to 10 conservative amino acid substitutions. In another or further embodiment of any of the foregoing, said one or more non-natural TCR antigen binding domain(s) comprises an scFv domains comprising one or more light chain complementary determining region of a variable light (vL) domain comprising a sequence of any one of SEQ ID Nos:2307 to 2482 or 12042 to 12159 and one or more heavy chain complementary determining regions of a variable heavy (vH) domain comprising a sequence of any one of SEQ ID Nos:2506 to 2680 or 12160 to 12278. In another or further embodiment of any of the foregoing, said one or more non-natural TCR antigen binding domain(s) comprises an scFv fragment having a sequence selected from the group consisting of SEQ ID NO:2770 to 2939, 12303 to 12357 or 18162 to 18224 each having up to 10 conservative amino acid substitutions. In another or further embodiment of any of the foregoing, said one or more non-natural TCR antigen binding domain(s) comprises one or more receptors comprising of amino acid sequences of any of SEQ ID Nos: 2736 to 2748 having up to 10 conservative amino acid substitutions. In another or further embodiment of any of the foregoing, said one or more non-natural TCR antigen binding domain(s) comprises one or more ligands comprising a sequence of any of SEQ ID NOs: 2758-2768 or 12359 to 12361 having up to 10 conservative amino acid substitutions. In another or further embodiment of any of the foregoing, said one or more non-natural TCR antigen binding domain(s) comprising an extracellular domain of CD16A, NKG2D, CD4, PD1, desmoglein 3 (Dsg3), or CD4-DC-SIGN. In another or further embodiment of any of the foregoing, said one or more non-natural TCR antigen binding domain(s) comprising an extracellular domain of extracellular domain of one or more of hTPO, mTPO, CGHα chain, CGHβ chain, FHβ chain, LHβ chain, TSHβ chain, APRIL or combination thereof. In another or further embodiment of any of the foregoing, said one or more non-natural TCR antigen binding domain(s) comprises any single chain variable fragment (scFv) comprising a sequence of any of SEQ ID Nos:2770 to 2939, 12303 to 12357 or 18162 to 18224 and having up to 10 conservative amino acid substitutions, and a) any camelid vHH as set forth in any of SEQ ID Nos:2701 to 2725 or 12279 to 12294 having up to 10 conservative amino acid substitutions, or b) any non-immunoglobulin antigen binding domains having a sequence as set forth in any of SEQ ID NOs: 2728-2732 or 12296 to 12301 and having up to 10 conservative amino acid substitutions; or c) any extracellular domain of a receptor comprising of amino acid sequences of any of SEQ ID Nos: 2736 to 2748 having up to 10 conservative amino acid substitutions; or d) any extracellular domain of a ligand comprising a sequence of any of SEQ ID NOs: 2758-2768 or 12359 to 12361 having up to 10 conservative amino acid substitutions. In another or further embodiment of any of the foregoing, said one or more non-natural TCR antigen binding domain(s) comprises a camelid vHH as set forth in any of SEQ ID Nos:2701 to 2725 or 12279 to 12294 having up to 10 conservative amino acid substitutions, and a) any single chain variable fragment (scFv) comprising a sequence of any of SEQ ID Nos:2770 to 2939, 12303 to 12357 or 18162 to 18224 and having up to 10 conservative amino acid substitutions, or b) any non-immunoglobulin antigen binding domains having a sequence as set forth in any of SEQ ID NOs: 2728-2732 or 12296 to 12301 and having up to 10 conservative amino acid substitutions; or c) any extracellular domain of a receptor comprising of amino acid sequences of any of SEQ ID Nos: 2736 to 2748 having up to 10 conservative amino acid substitutions; or d) any extracellular domain of a ligand comprising a sequence of any of SEQ ID NOs: 2758-2768 or 12359 to 12361 having up to 10 conservative amino acid substitutions. In another or further embodiment of any of the foregoing, said one or more non-natural TCR antigen binding domain(s) is optionally connected to each of the TCR constant region chain by a linker region, wherein said linker region nucleic acid encodes an amino acid sequence selected from the group consisting of SEQ ID NO:2981 to 2992 and any combination thereof, or a sequence with at least 98% identity thereto; or said linker is encoded by a nucleic acid sequence selected from the group consisting of SEQ ID NO:701 to 714, or sequences with at least 98% identity thereto. In another or further embodiment of any of the foregoing, said one or more non-natural TCR antigen binding domain(s) has a binding affinity to its target antigen of at least 5-fold less than the antibody from which it is obtained. In another or further embodiment of any of the foregoing, the polynucleotide encoding the SIR further comprises a leader sequence or signal peptide that is present at the N-terminal of each chain and comprises a sequence selected from the group consisting of SEQ ID NO:1-9 and 10. In another or further embodiment of any of the foregoing, the at least one polynucleotide encodes two SIRs. In another or further embodiment of any of the foregoing, the polynucleotide encodes two SIRs that are linked by nucleotide sequences encoding a cleavable linker. In another or further embodiment of any of the foregoing, the cleavable linker is a self-cleaving cleavable linker. In another or further embodiment of any of the foregoing, the cleavable linker is any one or more of a 2A linker, a 2A-like linker or functional equivalent thereof. In another or further embodiment of any of the foregoing, the cleavable linker is any one or more of T2A linker, P2A, F2A, E2A linker or functional equivalent thereof. In another or further embodiment of any of the foregoing, the cleavable linker comprises a sequence of any one or more of SEQ ID Nos:780 to 785. In another or further embodiment of any of the foregoing, the polynucleotide sequences encoding the cleavable linker is optionally preceded by a nucleotide sequence encoding a furine cleavage site or furine like cleavage site or functional equivalent thereof. In another or further embodiment of any of the foregoing, the furine cleavage site preceding the cleavable linker comprises a sequence of any one or more of SEQ ID Nos:788 to 790. In another or further embodiment of any of the foregoing, the polynucleotide sequences encoding the cleavable linker is preceded by a nucleotide sequence encoding a flexible linker. In another or further embodiment of any of the foregoing, the flexible linker preceding the cleavable linker encodes for one or more of Ser-Gly linker, Ser-Gly-Ser-Gly linker or functional equivalent thereof. In another or further embodiment of any of the foregoing, the flexible linker preceding the cleavable linker comprises a sequence of SEQ ID Nos: 786 or 787. In another or further embodiment of any of the foregoing, the polynucleotide sequences encoding the furine cleavage site is followed by polynucleotide encoding the flexible linker which is followed by polynucleotide encoding the cleavable linker so that the order is Furine cleavage site-Flexible linker-cleavable linker. In another or further embodiment of any of the foregoing, the polynucleotide encoding the cleavable linker are present before a sequence encoding a leader sequence (signal peptide) encoding a second SIR. In another or further embodiment of any of the foregoing, the SIRs can be designed to have a diverse binding affinity for a selected antigen. In another or further embodiment of any of the foregoing, the SIRs comprise an accessory module. In another or further embodiment of any of the foregoing, the accessory module comprises a CD3z domain. In a further embodiment of any of the foregoing, the TCR constant chain is selected from the group consisting of (viii) an amino acid sequence that is at least 98% identical to SEQ ID NO:12401 or 12402 or 12403 or 12408 or 12409; (ix) an amino acid sequence that is at least 98% identical to SEQ ID NO:12421 or 12422 or 12423 or 12427 or 12428; and (x) a dimer combination of two TCR constant chains of (viii) and (ix). In another or further embodiment of any of the foregoing, said one or more non-natural TCR antigen binding domain(s) bind to CD19. In another or further embodiment of any of the foregoing, the one or more non-natural TCR antigen binding domain(s) are selected from the group consisting of: a polypeptide comprising a sequence that is at least 98% identical to any one of SEQ ID NO:2318-2324, 12060-12068, 12108, 12127, or 12156 or any complement determining region (CDR) contained in any of the foregoing polypeptide; a polypeptide comprising a sequence that is at least 98% identical to any one of SEQ ID NO: 2517-2523, 12178-12186, 1227, 12246 or 12275 or any complement determining region (CDR contained in any of the foregoing polypeptides; a polypeptide comprising a sequence that is at least 98% identical to SEQ ID NO:12288; and a polypeptide comprising a sequence that is at least 98% identical to any one of SEQ ID NO:2770-2774, 12325, 12308, 18162-18170 or 12354. In another or further embodiment of any of the foregoing, the recombinant polynucleotide encodes a polypeptide comprising a sequence selected from the group consisting of SEQ ID Nos:3135-3235, 3250-3346, 3396, 3401-3403, 3406, 3429-3432, 3435-3439, 3540, 3855-3859, 12431-12489, 12491-12493, 12495-12530, 12534, 13195-13203, 13250, 13267, 13289, 13429-13437, 13483, 13501 and 13523. In another embodiment, said one or more non-natural TCR antigen binding domain(s) bind to CD20. In another or further embodiment of any of the foregoing the one or more non-natural TCR antigen binding domain(s) are selected from the group consisting of a polypeptide comprising a sequence that is at least 98% identical to any one of SEQ ID NO:2325-2326, 12069-12077 or 12078 or any complement determining region (CDR) contained in any of the foregoing polypeptides; a polypeptide comprising a sequence that is at least 98% identical to any one of SEQ ID NO: 2524-2525, 12187-12195 or 12196 or any complement determining region (CDR contained in any of the foregoing polypeptides; a polypeptide comprising a sequence that is at least 98% identical to SEQ ID NO:12289 or 12290; and a polypeptide comprising a sequence that is at least 98% identical to any one of SEQ ID NO:2787-2788, 18177-18186 or 18187. In another or further embodiment of any of the foregoing, the recombinant polynucleotide encodes a polypeptide comprising a sequence selected from the group consisting of SEQ ID Nos:3263, 3348, 3456-3457, 3876-3877, 12464-12465, 12477-12482, 12492, 12534, 13204-13213, 13438-13446 and 13447. In another embodiment, said one or more non-natural TCR antigen binding domain(s) bind to CD22. In another or further embodiment of any of the foregoing, the one or more non-natural TCR antigen binding domain(s) are selected from the group consisting of: a polypeptide comprising a sequence that is at least 98% identical to any one of SEQ ID NO:2327-2329, 12122-12126 or 12132 or any complement determining region (CDR) contained in any of the foregoing polypeptides; a polypeptide comprising a sequence that is at least 98% identical to any one of SEQ ID NO: 2526-2528, 12241-12245, or 12251 or any complement determining region (CDR contained in any of the foregoing polypeptides; and a polypeptide comprising a sequence that is at least 98% identical to any one of SEQ ID NO:2789-2791, 12320-12330, or 18188. In another or further embodiment of any of the foregoing, the recombinant polynucleotide encodes a polypeptide comprising a sequence selected from the group consisting of SEQ ID Nos:3332, 3433, 3458-3460, 3878-3880, 12483, 12485, 12488-12490, 13241-13245, 13268, 13475-13479 and 13502. In another embodiment, said one or more non-natural TCR antigen binding domain(s) bind to BCMA. In another or further embodiment of any of the foregoing, the one or more non-natural TCR antigen binding domain(s) are selected from the group consisting of: a polypeptide comprising a sequence that is at least 98% identical to any one of SEQ ID NO:2310-2313, 12046-12048, 12118-12119, 12139-12145 or 12146 or any complement determining region (CDR) contained in any of the foregoing polypeptides; a polypeptide comprising a sequence that is at least 98% identical to any one of SEQ ID NO: 2509-2512, 12164-12166, 12237-12238, 12258-12264 or 12265 or any complement determining region (CDR contained in any of the foregoing polypeptides; a polypeptide comprising a sequence that is at least 98% identical to SEQ ID NO:12279-12281, 12283-12285, 12287, 12291-12292, 12293 or 12294; and a polypeptide comprising a sequence that is at least 98% identical to any one of SEQ ID NO:2780-2783, 12237-12344, 18174-18175 or 18176. In another or further embodiment of any of the foregoing, the recombinant polynucleotide encodes a polypeptide comprising a sequence selected from the group consisting of SEQ ID Nos:3445-3449, 3866-3869, 12463, 12533, 12535-12536, 13181-13183, 13261-13262, 13277-13284, 13415-13417, 13495-13496, 13511-13517 and 13518. In another embodiment, said one or more non-natural TCR antigen binding domain(s) bind to MPL. In another or further embodiment of any of the foregoing, the one or more non-natural TCR antigen binding domain(s) are selected from the group consisting of: a polypeptide comprising a sequence that is at least 98% identical to any one of SEQ ID NO:2414-2421, 12120, 12128 or 12129 or any complement determining region (CDR) contained in any of the foregoing polypeptides; a polypeptide comprising a sequence that is at least 98% identical to any one of SEQ ID NO: 2611-2618, 12239, 12247 or 12248 or any complement determining region (CDR contained in any of the foregoing polypeptides; and a polypeptide comprising a sequence that is at least 98% identical to any one of SEQ ID NO:2871-2878, 12326-12327 and 12318. In another or further embodiment of any of the foregoing, the recombinant polynucleotide encodes a polypeptide comprising a sequence selected from the group consisting of SEQ ID Nos:3347, 3373, 3427-3428, 3495, 3556-3562, 3979-3985, 4025, 12454, 12456, 12458, 12462, 12532, 13259, 13265-13266, 13493, 13499 and 13500. In another embodiment, said one or more non-natural TCR antigen binding domain(s) bind to CS1. In another or further embodiment of any of the foregoing, the one or more non-natural TCR antigen binding domain(s) are selected from the group consisting of: a polypeptide comprising a sequence that is at least 98% identical to any one of SEQ ID NO:2355-2358, 12090-12094 or 12095 or any complement determining region (CDR) contained in any of the foregoing polypeptides; a polypeptide comprising a sequence that is at least 98% identical to any one of SEQ ID NO:2553-2555, 12209-12213, or 12214 or any complement determining region (CDR contained in any of the foregoing polypeptides; and a polypeptide comprising a sequence that is at least 98% identical to any one of SEQ ID NO:2817-2819, 18211-18215 or 18216. In another or further embodiment of any of the foregoing, the recombinant polynucleotide encodes a polypeptide comprising a sequence selected from the group consisting of SEQ ID Nos:3376, 3487-3489, 3907-3909, 12455, 12457, 12459, 12461, 12476, 13226-13231, 13460-13464 and 13465. In another embodiment, said one or more non-natural TCR antigen binding domain(s) bind to CD33. In another or further embodiment of any of the foregoing, the one or more non-natural TCR antigen binding domain(s) are selected from the group consisting of: a polypeptide comprising a sequence that is at least 98% identical to any one of SEQ ID NO:2336-2337, 12079-12084 or 12085 or any complement determining region (CDR) contained in any of the foregoing polypeptides; a polypeptide comprising a sequence that is at least 98% identical to any one of SEQ ID NO:2535-2536, 12197-12202 or 12203 or any complement determining region (CDR contained in any of the foregoing polypeptides; and a polypeptide comprising a sequence that is at least 98% identical to any one of SEQ ID NO:2795-2796, 18189-18193 or 18194. In another or further embodiment of any of the foregoing, the recombinant polynucleotide encodes a polypeptide comprising a sequence selected from the group consisting of SEQ ID Nos:3464-3465, 3884-3885, 12460, 12473, 12479, 13214-13220, 13448-13453 and 13454. In another embodiment, said one or more non-natural TCR antigen binding domain(s) bind to CD123.

In another or further embodiment of any of the foregoing, the one or more non-natural TCR antigen binding domain(s) are selected from the group consisting of: a polypeptide comprising a sequence that is at least 98% identical to any one of SEQ ID NO:2315, 2472, 12049-12058 or 12059 or any complement determining region (CDR) contained in any of the foregoing polypeptides; a polypeptide comprising a sequence that is at least 98% identical to any one of SEQ ID NO:2514, 2670, 12167-12176 or 12177 or any complement determining region (CDR contained in any of the foregoing polypeptides; a polypeptide comprising a sequence that is at least 98% identical to SEQ ID NO:2716 or 2717; and a polypeptide comprising a sequence that is at least 98% identical to any one of SEQ ID NO:2801, 2929, 18196-18205 or 18206. In another or further embodiment of any of the foregoing, the recombinant polynucleotide encodes a polypeptide comprising a sequence selected from the group consisting of SEQ ID Nos:3266-3267, 3366-3368, 3375, 3378, 3405, 3409, 3434, 3470, 3492-3497, 3617, 3890, 3912-3913, 4041, 12480, 13184-13194, 13418-13427 and 13428. In yet another embodiment, said one or more non-natural TCR antigen binding domain(s) bind to folate receptor 1. In another or further embodiment of any of the foregoing, the one or more non-natural TCR antigen binding domain(s) are selected from the group consisting of: a polypeptide comprising a sequence that is at least 98% identical to 2373 or any complement determining region (CDR) contained therein; a polypeptide comprising a sequence that is at least 98% identical to any one of SEQ ID NO:2570 or any complement determining region (CDR contained in therein; and a polypeptide comprising a sequence that is at least 98% identical to any one of SEQ ID NO:2833. In another or further embodiment of any of the foregoing, the recombinant polynucleotide encodes a polypeptide comprising a sequence selected from the group consisting of SEQ ID Nos:3511 and 3928. In yet another embodiment, said one or more non-natural TCR antigen binding domain(s) bind to mesothelin. In another or further embodiment of any of the foregoing, the one or more non-natural TCR antigen binding domain(s) are selected from the group consisting of: a polypeptide comprising a sequence that is at least 98% identical to any one of SEQ ID NO:2413, 12154 or 12155 or any complement determining region (CDR) contained in any of the foregoing polypeptides; a polypeptide comprising a sequence that is at least 98% identical to any one of SEQ ID NO:2609-2610, 12273 or 12274 or any complement determining region (CDR contained in any of the foregoing polypeptides; a polypeptide comprising a sequence that is at least 98% identical to SEQ ID NO:2713-2714 or 2725; and a polypeptide comprising a sequence that is at least 98% identical to any one of SEQ ID NO:2870, 2899, 12352 or 12353. In another or further embodiment of any of the foregoing, the recombinant polynucleotide encodes a polypeptide comprising a sequence selected from the group consisting of SEQ ID Nos:3414, 3419, 3554, 3585, 3976, 4008, 13287-13288, 13521 and 13522. In yet another embodiment, said one or more non-natural TCR antigen binding domain(s) bind to IL13Ra2. In another or further embodiment of any of the foregoing, the one or more non-natural TCR antigen binding domain(s) are selected from the group consisting of: —a polypeptide comprising a sequence that is at least 98% identical to any one of SEQ ID NO:2399 or 2400 or any complement determining region (CDR) contained in any of the foregoing polypeptides; a polypeptide comprising a sequence that is at least 98% identical to any one of SEQ ID NO:2595 or 2596 or any complement determining region (CDR contained in any of the foregoing polypeptides; and a polypeptide comprising a sequence that is at least 98% identical to any one of SEQ ID NO:2858 or 2859 In another or further embodiment of any of the foregoing, the recombinant polynucleotide encodes a polypeptide comprising a sequence selected from the group consisting of SEQ ID Nos:3541-3542, 3963 and 3964. In another embodiment, said one or more non-natural TCR antigen binding domain(s) bind to CD138. In another or further embodiment of any of the foregoing, the one or more non-natural TCR antigen binding domain(s) are selected from the group consisting of: a polypeptide comprising a sequence that is at least 98% identical to SEQ ID NO:2316 or any complement determining region (CDR) contained therein; a polypeptide comprising a sequence that is at least 98% identical to SEQ ID NO:2515 or any complement determining region (CDR contained therein; and a polypeptide comprising a sequence that is at least 98% identical to SEQ ID NO:2802. In another or further embodiment of any of the foregoing, the recombinant polynucleotide encodes a polypeptide comprising a sequence selected from the group consisting of SEQ ID Nos:3268, 3374, 3404, 3471 and 3891. In yet another embodiment, said one or more non-natural TCR antigen binding domain(s) bind to TCRgd. In another or further embodiment of any of the foregoing, the one or more non-natural TCR antigen binding domain(s) are selected from the group consisting of: a polypeptide comprising a sequence that is at least 98% identical to SEQ ID NO:2449 or any complement determining region (CDR) contained therein; a polypeptide comprising a sequence that is at least 98% identical to SEQ ID NO:2646 or any complement determining region (CDR) contained therein; and a polypeptide comprising a sequence that is at least 98% identical to SEQ ID NO:2907. In another or further embodiment of any of the foregoing, the recombinant polynucleotide encodes a polypeptide comprising a sequence selected from the group consisting of SEQ ID Nos:3594 and 4017. In still another embodiment, said one or more non-natural TCR antigen binding domain(s) bind to TCRB1. In another or further embodiment of any of the foregoing, the one or more non-natural TCR antigen binding domain(s) are selected from the group consisting of: a polypeptide comprising a sequence that is at least 98% identical to any one of SEQ ID NO:2445 or 2446 or any complement determining region (CDR) contained in any of the foregoing polypeptides; a polypeptide comprising a sequence that is at least 98% identical to any one of SEQ ID NO:2642 or 2643 or any complement determining region (CDR contained in any of the foregoing polypeptides; and a polypeptide comprising a sequence that is at least 98% identical to any one of SEQ ID NO:2903 or 2904. In another or further embodiment of any of the foregoing, the recombinant polynucleotide encodes a polypeptide comprising a sequence selected from the group consisting of SEQ ID Nos:3590-3591, 4013 and 4014. In another embodiment, said one or more non-natural TCR antigen binding domain(s) bind to TCRB2. In another or further embodiment of any of the foregoing, the one or more non-natural TCR antigen binding domain(s) are selected from the group consisting of: a polypeptide comprising a sequence that is at least 98% identical to any one of SEQ ID NO:2447 or 2448 or any complement determining region (CDR) contained in any of the foregoing polypeptides; a polypeptide comprising a sequence that is at least 98% identical to any one of SEQ ID NO:2644 or 2645 or any complement determining region (CDR) contained in any of the foregoing polypeptides; and a polypeptide comprising a sequence that is at least 98% identical to any one of SEQ ID NO:2905 or 2906. In another or further embodiment of any of the foregoing, the recombinant polynucleotide encodes a polypeptide comprising a sequence selected from the group consisting of SEQ ID Nos:3353-3364, 3592-3593, 4015 and 4016.

The disclosure also provide a recombinant expression system comprising any of the recombinant polynucleotide described herein an above which is/are co-expressed with a therapeutic control, wherein the therapeutic control is selected from the group consisting of a truncated epidermal growth factor receptor (tEGFR), truncated epidermal growth factor receptor viii (tEGFRviii), truncated CD30 (tCD30), truncated BCMA (tBCMA), truncated CD19 (tCD19), CD34, thymidine kinase, cytosine deaminase, nitroreductase, xanthine-guanine phosphoribosyl transferase, human caspase 8, human caspase 9, inducible caspase 9 (icaspase9), purine nucleoside phosphorylase, linamarase/linamarin/glucose oxidase, deoxyribonucleoside kinase, horseradish peroxidase (HRP)/indole-3-acetic (IAA), Gamma-glutamylcysteine synthetase, CD20/alphaCD20, CD34/thymidine kinase chimera, dox-dependent caspase-2, mutant thymidine kinase (HSV-TKSR39), AP1903/Fas system, a chimeric cytokine receptor (CCR), a selection marker, and combinations thereof. In one embodiment, the tEGFR and tEGFRviii bind any one or more of an EGFR-specific siRNA, a small molecule, an anti-EGFR antibody or a fragment thereof, or a combination thereof. In another embodiment, the tCD30 binds any one or more of a CD30-specific siRNA, a small molecule, an anti-CD30 antibody or a fragment thereof, or a combination thereof. In still another embodiment, the tCD19 binds any one or more of a CD19-specific siRNA, a small molecule, an anti-CD19 antibody or a fragment thereof, or a combination thereof. In another embodiment, the CD34 binds any one or more of a CD34-specific siRNA, a small molecule, an anti-CD34 antibody or a fragment thereof, or a combination thereof. In yet another embodiment, the selection marker comprises any one or more of dihydroxyfolate receptor (DHFR), mutant DHFR, methylated-DNA-protein-cysteine methyltransferase, inosine monophosphate dehydrogenase II (IMDHP2), puromycin acetyle transferase (PAC), blasticidin-resistance gene, mutant calcinueurin a/b (Can/b), CNa12, CNb30 or combinations thereof. In another embodiment, the CCR comprises any one or more of (i) IL-7 cytokine-linker-IL 7Ra, (ii) IL-7 cytokine-linker-extracellular domain of IL-7Ra-transmembrane domain of IL-7Ra-cytoplasmic domain of IL2Rβ, (iii) IL-7 cytokine linker-IL2Rβ, and (iv) combinations thereof. In another or further embodiment of any of the foregoing, the recombinant expression system comprises a recombinant polynucleotide of the disclosure which is co-expressed with an accessory module, wherein the accessory module is selected from the group consisting of 41BBL, CD40L, K13, MC159, cFLIP-L/MRITU, cFLIP-p22, HTLV1 Tax, HTLV2 Tax, HTLV2 Tax-RS mutant, FKBPx2-K13, FKBPx2-HTLV2-Tax, FKBPx2-HTLV2-Tax-RS, IL6R-304-vHH-Alb8-vHH, IL12f, PD1-4H1 scFV, PD1-5C4 scFV, PD1-4H1-Alb8-vHH, PD1-5C4-Alb8-vHH, CTLA4-Ipilimumab-scFv, CTLA4-Ipilimumab-Alb8-vHH, IL6-19A-scFV, IL6-19A-scFV-Alb8-vHH, sHVEM, sHVEM-Alb8-vHH, hTERT, Fx06, CD3z, CD3z-GGGS-41BB, CD3-BBz, CD3-CD28z, CD3-CD28-Lck fusion protein, shRNA targeting Brd4, chimeric antigen receptor (CAR), hTERT, heparinase, a CAR, an inhibitory CAR and any combination thereof. In another or further embodiment of any of the foregoing, the recombinant polynucleotide encoding the SIR and one or more therapeutic control and/or one or more accessory module are linked by nucleotide sequences encoding a cleavable linker. In a further embodiment, the cleavable linker is a self-cleaving cleavable linker. In another or further embodiment of any of the foregoing, the polynucleotide sequences encoding the cleavable linker is preceded by nucleotide sequence encoding a furine cleavage site or furine like cleavage site or functional equivalent thereof. In another or further embodiment of any of the foregoing, the polynucleotide sequences encoding the cleavable linker is optionally preceded by nucleotide sequence encoding a flexible linker.

The disclosure also provides at least one vector comprising the recombinant polynucleotide of as described herein and above, wherein the vector is selected from the group consisting of a DNA vector, an RNA vector, a plasmid, a lentivirus vector, adenoviral vector, a retrovirus vector, a baculovirus vector, a sleeping beauty transposon vector, and a piggybac transposon vector. I one embodiment, the vector backbone has a sequence selected from the group consisting of SEQ ID NO: 870 to 875 and 876. In another embodiment, the vector comprises a promoter chosen from an EF-1 promoter, a CMV IE gene promoter, an EF-1a promoter, an ubiquitin C promoter, a MSCV LTR promoter, or a phosphoglycerate kinase (PGK) promoter. In a further embodiment, the EF-1 promoter comprises a sequence of SEQ ID NO: 877 or a sequence with or a sequence with 80-99% identity thereto. In another or further embodiment of any of the foregoing, the vector is an in vitro transcribed vector, or the vector further comprises a poly(A) tail or a 3'UTR.

The disclosure provide at least one polypeptide encoded by the at least one recombinant polynucleotide of the disclosure.

The disclosure also provides a recombinant cell that expresses the at least one recombinant polynucleotide as described herein and above.

The disclosure also provides an isolated synthetic immune receptor (SIR) polypeptide or polypeptide heterodimer comprising: (a) a T-cell receptor (TCR) constant chain having an amino acid sequence selected from the group consisting of: (i) an amino acid sequence that is at least 98% identical to SEQ ID NO:3010 and has one or more mutations at positions 48, 61, 91, 92, 93, and/or 94 and which may comprise an optional accessory module; (ii) an amino acid sequence that is at least 98% identical to SEQ ID NO:3024 and has one or more mutations at positions 18, 22, 57, 79, 133, 136 and/or 139 and which may comprise an optional accessory module; (iii) an amino acid sequence that is at least 98% identical to SEQ ID NO:3025 and has one or more mutations at position 18, 22, 57, 79, 133, 136 and/or 139 and which may comprise an optional accessory module; (iv) an amino acid sequence that is at least 98% identical to SEQ ID NO:3046, 3047 or 3048 and which may comprise an optional accessory module; (v) an amino acid sequence that is at least 98% identical to SEQ ID NO:3049 and which may comprise an optional accessory module; (vi) an amino acid sequence that is at least 98% identical to SEQ ID NO:3051 or 3052 and which may comprise an optional accessory module; and (vii) a dimer combination of two TCR constant chains selected from (i) and (ii), (i) and (iii), (iv) and (ii), (iv) and (iii), or (v) and (vi); (b) an optional linker; and (c) one or more non-natural TCR antigen binding domain(s) linked to (a) selected from the group consisting of: (1) an antibody; (2) an antibody fragment (e.g. a Fv, a Fab, a (Fab')2); (3) a heavy chain variable region of an antibody (vH domain) or a fragment thereof; (4) a light chain variable region of an antibody (vL domain) or a fragment thereof; (5) a single chain variable fragment (scFv) or a fragment thereof; (6) a single domain antibody (SDAB) or a fragment thereof; (7)

a camelid VHH domain or a fragment thereof; (8) a monomeric variable region of an antibody; (9) a non-immunoglobulin antigen binding scaffold such as a DARPIN, an affibody, an affilin, an adnectin, an affitin, an obodies, a repebody, a fynomer, an alphabody, an avimer, an atrimer, a centyrin, a pronectin, an anticalin, a kunitz domain, an Armadillo repeat protein or a fragment thereof; (10) a receptor or a fragment thereof; (11) a ligand or a fragment thereof; (12) a bispecific-antibody, -antibody fragment, -scFV, -vHH, -SDAB, -non-immunoglobulin antigen binding scaffold, -receptor or -ligand; and (13) an autoantigen or a fragment thereof, wherein the mutations of (a)(i)-(a)(iii) provide a diverse binding affinity to a target antigen of the antigen binding domain and which synthetic immune receptor, upon expression in a lymphocyte, expresses both said antigen binding domain and said T cell receptor constant chain in one or more continuous chains on the surface of the lymphocytes such that lymphocytes are triggered to activate, proliferate, secrete cytokines and/or modulate (induce or suppress) killing of the target cells and have MHC-restricted or MHC-non-restricted antibody-type specificity when said expressed antigen binding domain binds to its antigen. In another or further embodiment of any of the foregoing, the TCR constant chains of (a)(vii) has a non-natural TCR binding domains selected from the group consisting of: variable regions of a heavy and light chains of an antibody or fragments thereof specific for a predefined target antigen, such that, when expressed, one of said heavy and light chains of the antibody or fragments thereof is attached to one of said two chains of (a)(vii) of said T-cell constant region and the other of said heavy and light chains of the antibody or fragments thereof is attached to the other of said two chains of said T-cell constant regions; two single chain variable fragments (scFv) specific for one or more predefined target antigens, such that, when expressed, one of said scFv is attached to one of said two chains of (a)(vii) of said T-cell constant region and the other of said scFv is attached to the other of said two chains of said T-cell constant regions; two antibody fragment specific for one or more predefined target antigens, such that, when expressed, one of said antibody fragments is attached to one of said two chains of (a)(vii) of said T-cell constant region and the other of said antibody fragments is attached to the other of said two chains of said T-cell constant regions; two single domain antibody (SDAB) fragments specific for one or more predefined target antigens, such that, when expressed, one of said SDAB fragments is attached to one of said two chains of (a)(vii) of said T-cell constant region and the other of SDAB fragments is attached to the other of said two chains of said T-cell constant regions; two camelid vHH domains specific for one or more predefined target antigens, such that, when expressed, one of said vHH domains is attached to one of said two chains of (a)(vii) of said T-cell constant region and the other of vHH domains is attached to the other of said two chains of said T-cell constant regions; two non-immunoglobulin antigen binding scaffolds specific for one or more predefined target antigens, such that, when expressed, one of said non-immunoglobulin antigen binding scaffolds is attached to one of (a)(vii) of said two chains of said T-cell constant region and the other of said non-immunoglobulin antigen binding scaffolds domains is attached to the other of said two chains of said T-cell constant regions; two receptors or a fragment thereof specific for one or more predefined target antigens, such that, when expressed, one of said receptors or a fragment thereof is attached to one of said two chains of (a)(vii) of said T-cell constant region and the other of said receptors or a fragment thereof is attached to the other of said two chains of said T-cell constant regions; two ligands or a fragment thereof specific for one or more predefined target antigens, such that, when expressed, one of said ligands or a fragment thereof is attached to one of said two chains of (a)(vii) of said T-cell constant region and the other of said ligands or a fragment thereof is attached to the other of said two chains of said T-cell constant regions; two structurally distinct antigen binding fragments specific for one or more predefined target antigens, such that, when expressed, one of said antigen binding fragments is attached to one of (a)(vii) of said two chains of said T-cell constant region and the other of said antigen binding fragments is attached to the other of said two chains of said T-cell constant regions; two binding fragments one or both of which are bispecific or multispecific such that, when expressed, one of said antigen binding fragments is attached to one of said two chains of (a)(vii) of said T-cell constant region and the other of said antigen binding fragments is attached to the other of said two chains of said T-cell constant regions; two autoantigens or fragment thereof, such that, when expressed, one of said autoantigens or fragments thereof is attached to one of (a)(vii) of said two chains of said T-cell constant region and the other of said autoantigens or fragments thereof is attached to the other of said two chains of said T-cell constant regions; and two vL or fragment thereof, such that, when expressed, one of said vL or fragments thereof is attached to one of (a)(vii) of said two chains of said T-cell constant region and the other of said vL or fragments thereof is attached to the other of said two chains of said T-cell constant regions; two vH or fragment thereof, such that, when expressed, one of said vH or fragments thereof is attached to one of (a)(vii) of said two chains of said T-cell constant region and the other of said vH or fragments thereof is attached to the other of said two chains of said T-cell constant regions. In another or further embodiment of any of the foregoing, the TCR constant chains of (a)(iv) has a non-natural TCR binding domains selected from the group consisting of: the variable region of the heavy chain (vH) of an antibody or a fragment thereof specific for a predefined target antigen; the variable region of the light chain (vL) of an antibody or a fragment thereof specific for a predefined target antigen; a single chain variable fragment (scFv) or a fragment thereof specific for a predefined target antigens; an antibody fragment (e.g., Fv, a Fab, a (Fab')2) specific for a predefined target antigen; a single domain antibody (SDAB) fragments specific for a predefined target antigen; a camelid vHH domain specific for a predefined target antigen; a non-immunoglobulin antigen binding scaffolds specific for a predefined target antigen; a receptors specific or a fragment thereof for a predefined target antigen; a ligands or a fragment thereof specific for a predefined target antigens; a bispecific-antibody, -antibody fragment, -scFV, -vHH, -SDAB, -non-immunoglobulin antigen binding scaffold, -receptor or -ligand specific for one or more predefined target antigens; and an autoantigen or a fragment thereof. In another or further embodiment of any of the foregoing, a TCR constant domain of (i), (ii), (iii), (iv), (v), or (vi) comprises a non-natural TCR binding domains selected from the group consisting of: a variable region of the heavy chain (vH) of an antibody specific for the predefined target antigen; a variable region of the light chain (vL) of an antibody specific for the predefined target antigen; a single chain variable fragment (scFv) specific for a predefined target antigens; an antibody fragment (e.g., Fv, a Fab, a (Fab')2) specific for a predefined target antigen; a single domain antibody (SDAB) fragments specific for a predefined target antigen; a camelid vHH domains specific for a predefined target antigen; a non-immunoglobulin antigen binding scaffolds specific for a predefined target antigen; a receptors specific for a predefined target antigen or fragments thereof; a ligands specific for a predefined target antigens or fragments thereof; a bispecific-antibody, -antibody fragment, -scFV, -vHH, -SDAB, -non-immunoglobulin antigen binding scaffold, -receptor or -ligand specific for one or more predefined target antigens; and an autoantigen or a fragment thereof In another or further embodiment of any of the foregoing, the TCR constant chain(s) comprise mutations that enhance the expression and/or pairing of TCR constant chains and reduce their pairing with the endogenous T cell receptor chains. In another or further embodiment of any of the foregoing, the constant region of TCR is a TCR receptor α chain (Cα) comprising an amino acid sequence having at having 1-40 amino acid substitutions or mutations to a sequence selected from the group consisting of SEQ ID NO: 3010 to 3023 or a sequence that is at least 98% identical to an amino acid sequences selected from the group consisting of SEQ ID NO: 3010 to 3023. In another or further embodiment of any of the foregoing, the constant region of TCR is a TCR receptor β chain (Cβ) comprising an amino acid sequence having 1-40 amino acid substitutions or mutations to a sequence selected from the group consisting of SEQ ID NO: 3024 to 3044 or a sequence that is at least 98% identical to an amino acid sequences selected from the group consisting of SEQ ID NO: 3024 to 3044. In another or further embodiment of any of the foregoing, the constant region of TCR is a TCR receptor γ chain (Cγ) comprising an amino acid sequence having 1-40 amino acid substitutions or mutations to a sequence selected from the group consisting of SEQ ID NO: 3049 to 3050 or a sequence that is at least 98% identical to an amino acid sequences selected from the group consisting of SEQ ID NO: 3049 to 3050. In another or further embodiment of any of the foregoing, the constant region of TCR is a TCR receptor δ chain (Cδ) comprising an amino acid sequence 1-40 amino acid substitutions or mutations to an amino acid sequence selected from the group consisting of SEQ ID NO:3051 to 3052 or a sequence that is at least 98% identical to a sequence selected from the group consisting of SEQ ID NO:3051 to 3052. In another or further embodiment of any of the foregoing, the constant region of TCR is a preTCR receptor α chain (preCα) comprising an amino acid sequence having 1-40 amino acid substitutions or mutations to an amino acid sequence selected from the group consisting of SEQ ID NO:3046 to 3048 or a sequence that is at least 98% identical to a sequence selected from the group consisting of SEQ ID NO: 3046 to 3048. In another or further embodiment of any of the foregoing, the one or more non-natural TCR antigen binding domain(s) bind to one or more of disease-associated antigens are selected from a group consisting of: CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8)aNeu5Ac(2-3)bDGalp(l-4)bDGlcp(l-1)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); Fins Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-llRa); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDClalp(l-4) bDGlcp(l-1)Cer); transglutaminase 5 (TGS5); high molecular weight-melanoma associated antigen (HMW-MAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGEl); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCT A-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B 1 (CYP1B 1); CCCTC-Binding Factor (Zinc Finger Protein)-Like (BORIS or Brother of the Regulator oflm printed Sites), Squamous Cell Carcinoma Antigen Recognized By T Cells 3 (SART3); Paired box protein Pax-5 (PAX5); proacrosin binding protein sp32 (OY-TESl); lymphocyte-specific protein tyrosine kinase (LCK); A kinase anchor protein 4 (AKAP-4); synovial sarcoma, X breakpoint 2 (SSX2); Receptor for Advanced Glycation End products (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen) Fucosyl-GM1, PTK7, gpNMB, CDH1-CD324, DLL3, CD276/B7H3, IL11Ra, IL13Ra2, CD179b-IGLl1, ALK TCR gamma-delta, NKG2D, CD32 (FCGR2A), Tn ag, CSPG4-HMW-MAA, Tim1-/HVCR1, CSF2RA (GM-CSFR-alpha), TGFbetaR2, VEGFR2/KDR, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Chorionic Gonadotropin Hormone receptor (CGHR), CCR4, GD3, SLAMF6, SLAMF4, HIV1 envelope glycoprotein, HTLV1-Tax, CMV pp65, EBV-EBNA3c, influenza A hemagglutinin (HA), GAD, PDL1, Guanylyl cyclase C (GCC), KSHV-K8.1 protein, KSHV-gH protein, auto antibody to desmoglein 3 (Dsg3), autoantibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IGE, CD99, RAS G12V, Tissue Factor 1 (TF1), AFP, GPRC5D, claudin18.2 (CLD18A2 OR CLDN18A.2)), P-glycoprotein, STEAP1, LIV1, NECTIN-4, CRIPTO, GPA33, BST1/CD157, low conductance chloride channel, and antigen recognized by TNT antibody. In another or further embodiment of any of the foregoing, the one or more non-natural TCR antigen binding domain(s) comprises an antibody, an antibody fragment, an scFv, a Fv, a Fab, a (Fab')2, a single domain antibody (SDAB), a vH or vL domain, a camelid vHH domain, a non-immunoglobulin antigen binding scaffolds such as DARPINs, affibodies, affilins, adnectins, affitins, obodies, repebodies, fynomers, alphabodies, avimers, atrimers, centyrins, pronectins, anticalins, kunitz domains, Armadillo repeat proteins, a receptor or a ligand. In another or further embodiment of any of the foregoing, the one or more non-natural TCR antigen binding domain(s) is selected from the group consisting of: (i) a heavy chain variable region (vH) comprising a sequence as set forth in any of SEQ ID Nos:2506 to 2680 or 12160 to 12278 or sequences with at least 98% identity thereto and which encodes a polypeptide the binds to its antigen; (ii) a light chain variable region (vL) comprising a sequence as set forth in any one of SEQ ID NO 2307 to 2482 or 12042 to 12159 or sequences with at least 98% identity thereto and which encodes a polypeptide the binds to its antigen; (iii) a single chain variable fragment (scFv) comprising a sequence as set forth in any one SEQ ID NO: 2770 to 2939, 12303 to 12357, or 18162 to 18224 or sequences with at least 98% identity thereto and which encodes a polypeptide the binds to its antigen; (iv) a camelid VHH domain comprising a sequence as set forth in any one of SEQ ID NO: 2701 to 2725 or 12279 to 12294 or sequences with at least 98% identity thereto and which encodes a polypeptide the binds to its antigen; (v) a non-immunoglobulin scaffold encoded by a polynucleotide of any one of SEQ ID NO 439 to 443 or sequences with at least 98% identity thereto and which encodes a polypeptide the binds to its antigen; (vi) a receptor comprising a sequence as set forth in any one of SEQ ID NO 2736 to 2748 or sequences with at least 98% identity thereto and which encodes a polypeptide the binds to its cognate; and (vii) a ligand comprising a sequence as set forth in any one of SEQ ID NO 2758 to 2768 or 12359 to 12361 or sequences with at least 98% identity thereto and which encodes a polypeptide the binds to its cognate. In another or further embodiment of any of the foregoing, the one or more non-natural TCR antigen binding domain(s) comprise one or more of light chain complementary determining region for a selected target antigen as set forth in any of SEQ ID Nos:13999 to 14879 or 14880 and/or one or more of heavy chain complementary determining region for a selected target antigen as set forth in any of SEQ ID Nos:14881 to 15761 or 15762. In another or further embodiment of any of the foregoing, the one or more non-natural TCR antigen binding domain(s) comprises a variable light (vL) domain comprising a sequence of any one of SEQ ID Nos:2307 to 2482 or 12042 to 12159 having up to 10 conservative amino acid substitutions and/or a variable heavy (vH) domain comprising a sequence of any one of SEQ ID Nos:2506 to 2680 or 12160 to 12278 having up to 10 conservative amino acid substitutions. In another or further embodiment of any of the foregoing, the one or more non-natural TCR antigen binding domain(s) comprises one or more of camelid vHH complementary determining regions for a selected antigen as set forth in any of SEQ ID Nos:2701 to 2725 or 12279 to 12294 having up to 10 conservative amino acid substitutions. In another or further embodiment of any of the foregoing, the one or more non-natural TCR antigen binding domain(s) comprises a non-immunoglobulin antigen binding domains having a sequence as set forth in any of SEQ ID NOs: 2728-2732 or 12296 to 12301 and having up to 10 conservative amino acid substitutions. In another or further embodiment of any of the foregoing, the one or more non-natural TCR antigen binding domain(s) comprises an scFv domains comprising one or more light chain complementary determining region of a variable light (vL) domain comprising a sequence of any one of SEQ ID Nos:2307 to 2482 or 12042 to 12159 and one or more heavy chain complementary determining regions of a variable heavy (vH) domain comprising a sequence of any one of SEQ ID Nos:2506 to 2680 or 12160 to 12278. In another or further embodiment of any of the foregoing, the one or more non-natural TCR antigen binding domain(s) comprises an scFv fragment having a sequence selected from the group consisting of SEQ ID NO:2770 to 2939, 12303 to 12357 or 18162 to 18224 each having up to 10 conservative amino acid substitutions. In another or further embodiment of any of the foregoing, the one or more non-natural TCR antigen binding domain(s) comprises one or more receptors comprising of amino acid sequences of any of SEQ ID Nos: 2736 to 2748 having up to 10 conservative amino acid substitutions. In another or further embodiment of any of the foregoing, the one or more non-natural TCR antigen binding domain(s) comprises one or more ligands comprising a sequence of any of SEQ ID NOs: 2758-2768 or 12359 to 12361 having up to 10 conservative amino acid substitutions. In another or further embodiment of any of the foregoing, the one or more non-natural TCR antigen binding domain(s) comprising an extracellular domain of CD16A, NKG2D, CD4, PD1, desmoglein 3 (Dsg3), or CD4-DC-SIGN. In another or further embodiment of any of the foregoing, said one or more non-natural TCR antigen binding domain(s) comprising an extracellular domain of extracellular domain of one or more of hTPO, mTPO, CGHα chain, CGHβ chain, FHβ chain, LHβ chain, TSHβ chain, APRIL or combination thereof. In another or further embodiment of any of the foregoing, said one or more non-natural TCR antigen binding domain(s) comprises any single chain variable fragment (scFv) comprising a sequence of any of SEQ ID Nos:2770 to 2939, 12303 to 12357 or 18162 to 18224 and having up to 10 conservative amino acid substitutions, and a) any camelid vHH as set forth in any of SEQ ID Nos:2701 to 2725 or 12279 to 12294 having up to 10 conservative amino acid substitutions, or b) any non-immunoglobulin antigen binding domains having a sequence as set forth in any of SEQ ID NOs: 2728-2732 or 12296 to 12301 and having up to 10 conservative amino acid substitutions; or c) any extracellular domain of a receptor comprising of amino acid sequences of any of SEQ ID Nos: 2736 to 2748 having up to 10 conservative amino acid substitutions; or d) any extracellular domain of a ligand comprising a sequence of any of SEQ ID NOs: 2758-2768 or 12359 to 12361 having up to 10 conservative amino acid substitutions. In another or further embodiment of any of the foregoing, said one or more non-natural TCR antigen binding domain(s) comprises a camelid vHH as set forth in any of SEQ ID Nos:2701 to 2725 or 12279 to 12294 having up to 10 conservative amino acid substitutions, and a) any single chain variable fragment (scFv) comprising a sequence of any of SEQ ID Nos:2770 to 2939, 12303 to 12357 or 18162 to 18224 and having up to 10 conservative amino acid substitutions, or b) any non-immunoglobulin antigen binding domains having a sequence as set forth in any of SEQ ID NOs: 2728-2732 or 12296 to 12301 and having up to 10 conservative amino acid substitutions; or c) any extracellular domain of a receptor comprising of amino acid sequences of any of SEQ ID Nos: 2736 to 2748 having up to 10 conservative amino acid substitutions; or d) any extracellular domain of a ligand comprising a sequence of any of SEQ ID NOs: 2758-2768 or 12359 to 12361 having up to 10 conservative amino acid substitutions. In another or further embodiment of any of the foregoing, said one or more non-natural TCR antigen binding domain(s) is optionally connected to each of the TCR constant region chain by a linker region, wherein said linker region nucleic acid encodes an amino acid sequence selected from the group consisting of SEQ ID NO:2981 to 2992 and any combination thereof, or a sequence with at least 98% identity thereto; or said linker is encoded by a nucleic acid sequence selected from the group consisting of SEQ ID NO:701 to 714, or sequences with at least 98% identity thereto. In another or further embodiment of any of the foregoing, said one or more non-natural TCR antigen binding domain(s) has a binding affinity to its target antigen of at least 5-fold less than the antibody from which it is obtained. In another or further embodiment of any of the foregoing, the polynucleotide encoding the SIR further comprises a leader sequence or signal peptide that is present at the N-terminal of each chain and comprises a sequence selected from the group consisting of SEQ ID NO:1-9 and 10. In another or further embodiment of any of the foregoing, the SIR comprises a SIR heterodimer. In another or further embodiment of any of the foregoing, the polypeptide comprises two SIRs that are linked by a cleavable linker. In a further embodiment, the cleavable linker is a self-cleaving cleavable linker. In a further embodiment, the cleavable linker is any one or more of a 2A linker, a 2A-like linker or functional equivalent thereof. In still a further embodiment, the cleavable linker is any one or more of T2A linker, P2A, F2A, E2A linker or functional equivalent thereof. In still a further embodiment, the cleavable linker comprises a sequence of any one or more of SEQ ID Nos:780 to 785. In a further embodiment, the cleavable linker is optionally preceded by a furine cleavage site or furine like cleavage site or functional equivalent thereof. In yet a further embodiment, the furine cleavage site preceding the cleavable linker comprises a sequence of any one or more of SEQ ID Nos:788 to 790. In any of the foregoing embodiment, the cleavable linker is preceded by a flexible linker. In a further embodiment, the flexible linker preceding the cleavable linker encodes for one or more of Ser-Gly linker, Ser-Gly-Ser-Gly linker or functional equivalent thereof. In yet a further embodiment, the flexible linker preceding the cleavable linker comprises a sequence of SEQ ID Nos: 786 or 787. In yet a further embodiment, the furine cleavage site is followed by the flexible linker which is followed by the cleavable linker so that the order is Furine cleavage site-Flexible linker-cleavable linker. In another or further embodiment of any of the foregoing, the SIRs is designed to have a desired binding affinity for a selected antigen.

The disclosure also provide an immune effector cell or stem cell comprising at least one polypeptide or heterodimer as described herein and above.

The disclosure also provides an immune effector cell or stem cell comprising at least one recombinant polynucleotide as described herein and above.

The disclosure also provide an immune effector cell or stem cell comprising at least one vector of the disclosure as described herein and above.

In another or further embodiment of any of the foregoing, the immune cell or stem cell of any comprises a plurality of SIR polypeptides. In another or further embodiment of any of the foregoing, at least one SIR polypeptide of the plurality of SIR polypeptides targets a different antigen than at least one other SIR polypeptide. In another or further embodiment of any of the foregoing, at least one SIR polypeptide of the plurality of SIR polypeptides target the same antigen. In another or further embodiment of any of the foregoing, at least one SIR polypeptide of the plurality of SIR polypeptides comprises a different binding affinity for the antigen than at least one other SIR polypeptide. In another or further embodiment of any of the foregoing, the immune cell further comprises at least one chimeric antigen receptor (CAR) polypeptide. In another or further embodiment of any of the foregoing, the antigen binding domain of the SIR polypeptide targets a different antigen than the antigen binding domain of the CAR polypeptide. In another or further embodiment of any of the foregoing, the CAR polypeptide comprises an intracellular signaling domain comprising a costimulatory signaling domain, but does not comprise a primary signaling domain or comprises an intracellular signaling domain comprising a primary signaling domain, but does not comprise a costimulatory signaling domain. In another or further embodiment of any of the foregoing, the CAR polypeptide comprises a costimulatory signaling domain comprising a functional signaling domain of a protein selected from the group consisting of 4-1BB, CD28, CD27 or OX-40, or the CAR molecule comprises a primary signaling domain comprising a functional signaling domain of CD3 zeta. In another or further embodiment of any of the foregoing, the CAR polypeptide is an inhibitory CAR polypeptide, wherein the inhibitory CAR polypeptide comprises an antigen binding domain, a transmembrane domain, and an intracellular domain of an inhibitory molecule, wherein the inhibitory molecule is selected from the group consisting of PD1, PD-L1, CTLA4, TIM3, LAG3, VISTA, BTLA, TIGIT, LAIR1, CD160, 2B4, TGFR beta, CEACAM-1, CEACAM-3, and CEACAM-5. In another or further embodiment of any of the foregoing, the CAR polypeptide further comprises an intracellular signaling domain comprising a primary signaling domain and/or an intracellular signaling domain, wherein the intracellular signaling domain comprises a primary signaling domain comprising the functional domain of CD3 zeta and a costimulatory signaling domain comprising the functional domain of 4-1BB or CD28 or both. In another or further embodiment of any of the foregoing, the CAR polypeptide comprises the amino acid sequence of SEQ ID NO: 3077 to SEQ ID NO: 3083. In another or further embodiment of any of the foregoing, the immune effector cell is a human T cell, a human NK cell or a stem cell that can give rise to an immune effector cell, optionally, wherein the T cell is diaglycerol kinase (DGK) and/or Ikaros deficient and/or Brd4 deficient.

The disclosure provides a method of making a SIR-expressing immune effector cell, comprising introducing at least one vector of the disclosure or at least one recombinant polynucleotide of the disclosure into an immune effector cell or a hematopoietic stem cell or progenitor cell that can give rise to an immune effector cell, under conditions such that the SIR polypeptide is expressed. In another or further embodiment of any of the foregoing, the method further comprises a) providing a population of immune effector cells; and b) removing T regulatory cells from the population, thereby providing a population of T regulatory-depleted cells; wherein steps a) and b) are performed prior to introducing the vector or recombinant polynucleotide encoding the SIR to the population. In another or further embodiment of any of the foregoing, the T regulatory cells are removed from the cell population using an anti-CD25 antibody, or an anti-GITR antibody. In another or further embodiment of any of the foregoing, the method further comprises: a) providing a population of immune effector cells; and b) enriching P-glycoprotein (P-gp or Pgp; MDR1, ABCB1, CD243)-positive cells from the population, thereby providing a population of P-glycoprotein (P-gp or Pgp; MDR1, ABCB1, CD243)-enriched cells; wherein steps a) and b) are performed prior to or after introducing the vector or recombinant polynucleotide encoding the SIR. In another or further embodiment of any of the foregoing, the P-glycoprotein positive cells are enriched using any one or more of the methods selected from the group consisting of: i) immunoselection using one or a cocktail of P-glycoprotein specific antibodies, ii) staining with one or more of fluorescent dyes that are substrates of P-glycoprotein, tetramethylrhodamine methyl ester (TMRM), Adriamycin and actinomycin-D) under conditions at which P-glycoprotein is active as a pump and enriching for cells that stain less with the dye, iii) selection of cells that are resistant to phototoxic compounds that are substrates of P-glycoprotein, such as any one or more of TH9402, 2-(4,5-dibromo-6-amino-3-imino-3H-xanthen-9-yl)-benzoic acid methyl ester hydrochloride, 2-(4,5-dibromo-6-amino-3-imino-3H-xanthen-9-yl)-benzoic acid ethyl ester hydrochloride, 2-(4,5-dibromo-6-amino-3-imino-3H-xanthen-9-yl)-benzoic acid octyl ester hydrochloride, 2-(4,5-dibromo-6-amino-3-imino-3H-xanthen-9-yl)-benzoic acid n-butyl ester hydrochloride, 2-(6-ethyl amino-3-ethyl imino-3H-xanthen-9-yl)-benzoic acid n-butyl ester hydrochloride, or derivatives thereof or combinations thereof, and iv) selection of cells that are resistant to cytotoxic compounds that are substrates of P-glycoprotein, such as vincristine, vinblastine, taxol, paclitaxel, mitoxantrone, etoposide, adriamycin, daunorubicin and actinomycin-D.

The disclosure provides a method of generating a population of RNA-engineered cells comprising introducing in vitro transcribed RNA or RNAs or synthetic RNA or RNAs into a cell or population of cells, where the RNA or RNAs comprises a recombinant polynucleotide or polynucleotides as described herein an above.

The disclosure provides a method of providing anti-disease immunity in a subject comprising administering to the subject an effective amount of the immune effector cell or a stem cell that can give rise to an immune effector cell of the disclosure, wherein the cell is an autologous T cell or an allogeneic T cell, or an autologous NK cell or an allogeneic NK cell or an autologous or an allogeneic hematopoietic stem cell that can give rise to an immune effector cell. In one embodiment, the allogeneic T cell or allogeneic NK cell lacks expression or has low expression of a functional TCR or a functional HLA.

The disclosure also provides a composition comprising an immune effector cell or a stem cell that can generate immune effector cells comprising one or more of synthetic immune receptor (SIR) molecules for use in combination with an agent that increases the efficacy of the immune effector cell in the treatment of a subject having a disease associated with expression of a disease associated antigen or in the prevention of disease in a subject having an increased risk of a disease associated with expression of a disease associated antigen, wherein: (i) the SIR molecule comprises one or more of T-cell receptor constant chains joined via an optional linker to one or more antigen binding domains that bind to the disease-associated antigen associated with the disease, and said disease-associated antigen is selected from a group consisting of: CD5, CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8)aNeu5Ac(2-3)bD-Galp(1-4)bDGlcp(1-1)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); Fins Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100);

oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDClalp(l-4) bDGlcp(l-1)Cer); transglutaminase 5 (TGS5); high molecular weight-melanoma associated antigen (HMW-MAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ES0-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member lA (XAGEl); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCTA-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 lB 1 (CYPlB 1); CCCTC-Binding Factor (Zinc Finger Protein)-Like (BORIS or Brother of the Regulator oflm printed Sites), Squamous Cell Carcinoma Antigen Recognized By T Cells 3 (SART3); Paired box protein Pax-5 (PAX5); proacrosin binding protein sp32 (OY-TESl); lymphocyte-specific protein tyrosine kinase (LCK); A kinase anchor protein 4 (AKAP-4); synovial sarcoma, X breakpoint 2 (SSX2); Receptor for Advanced Glycation End products (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRl); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLECI2A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen) Fucosyl-GM1, PTK7, gpNMB, CDH1-CD324, DLL3, CD276/B7H3, IL11Ra, IL13Ra2, CD179b-IGL11, ALK TCR gamma-delta, NKG2D, CD32 (FCGR2A), CSPG4-HMW-MAA, Tim1-/HVCR1, CSF2RA (GM-CSFR-alpha), TGFbetaR2, VEGFR2/KDR, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Chorionic Gonadotropin Hormone receptor (CGHR), CCR4, SLAMF6, SLAMF4, HIV1 envelope glycoprotein, HTLV1-Tax, CMV pp65, EBV-EBNA3c, influenza A hemagglutinin (HA), GAD, PDL1, Guanylyl cyclase C (GCC), KSHV-K8.1 protein, KSHV-gH protein, auto-antibody to desmoglein 3 (Dsg3), autoantibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IGE, CD99, RAS G12V, Tissue Factor 1 (TF1), AFP, GPRC5D, claudin18.2 (CLD18A2 OR CLDN18A.2)), P-glycoprotein, STEAP1, LIV1, NECTIN-4, CRIPTO, GPA33, BST1/CD157, low conductance chloride channel, and antigen recognized by TNT antibody, (ii) the agent that increases the efficacy of the immune cell is chosen from one or more of: a protein phosphatase inhibitor; a kinase inhibitor (e.g., a PI3K/AKT inhibitor or an mTOR inhibitor); a cytokine; an inhibitor of an immune inhibitory molecule; an agent that decreases the level or activity of a TREG cell; an agent that increase the proliferation and/or persistence of SIR-modified cells; a chemokine; an agent that increases the expression of SIR; an agent that allows regulation of the expression or activity of SIR; an agent that allows control over the survival and/or persistence of SIR-modified cells; an agent that controls the side effects of SIR-modified cells; a Brd4 inhibitor; an agent that delivers a therapeutic (e.g. sHVEM) or prophylactic agent to the site of the disease; an agent that increases the expression of the target antigen against which SIR is directed; and an adenosine A2a receptor antagonist.

The disclosure provides a method of treating or preventing a disease associated with expression of a disease-associated antigen in a subject, comprising administering to the subject an effective amount of an immune effector cell comprising a synthetic immune receptor (SIR) molecule, in combination with an agent that increases the efficacy of the immune cell, wherein: (i) the SIR molecule comprises one or more of T-cell receptor constant chains joined via an optional linker to one or more of antigen binding domains that bind to the disease-associated antigen associated with the disease, and said disease-associated antigen is selected from a group consisting of: CD5, CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8)aNeu5Ac(2-3)bD-Galp(l-4)bDGlcp(l-1)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); Fins Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (ILllRa); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDClalp(1-4) bDGlcp(1-1)Cer); transglutaminase 5 (TGS5); high molecular weight-melanoma associated antigen (HMW-MAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ES0-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member lA (XAGEl); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCT A-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 lB 1 (CYPlB 1); CCCTC-Binding Factor (Zinc Finger Protein)-Like (BORIS or Brother of the Regulator oflm printed Sites), Squamous Cell Carcinoma Antigen Recognized By T Cells 3 (SART3); Paired box protein Pax-5 (PAX5); proacrosin binding protein sp32 (OY-TESl); lymphocyte-specific protein tyrosine kinase (LCK); A kinase anchor protein 4 (AKAP-4); synovial sarcoma, X breakpoint 2 (SSX2); Receptor for Advanced Glycation End products (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRl); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen) Fucosyl-GM1, PTK7, gpNMB, CDH1-CD324, DLL3, CD276/B7H3, IL11Ra, IL13Ra2, CD179b-IGLl1, ALK TCR gamma-delta, NKG2D, CD32 (FCGR2A), CSPG4-HMW-MAA, Tim1-/HVCR1, CSF2RA (GM-CSFR-alpha), TGFbetaR2, VEGFR2/KDR, Lewis Ag, TCR-beta1 chain, TCR-beta2 chain, TCR-gamma chain, TCR-delta chain, FITC, Leutenizing hormone receptor (LHR), Follicle stimulating hormone receptor (FSHR), Chorionic Gonadotropin Hormone receptor (CGHR), CCR4, SLAMF6, SLAMF4, HIV1 envelope glycoprotein, HTLV1-Tax, CMV pp65, EBV-EBNA3c, influenza A hemagglutinin (HA), GAD, PDL1, Guanylyl cyclase C (GCC), KSHV-K8.1 protein, KSHV-gH protein, auto antibody to desmoglein 3 (Dsg3), autoantibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IGE, CD99, RAS G12V, Tissue Factor 1 (TF1), AFP, GPRC5D, claudin18.2 (CLD18A2 OR CLDN18A.2)), P-glycoprotein, STEAP1, LIV1, NECTIN-4, CRIPTO, GPA33, BST1/CD157, low conductance chloride channel, and antigen recognized by TNT antibody, (ii) the agent that increases the efficacy of the immune cell is chosen from one or more of: a protein phosphatase inhibitor; a kinase inhibitor; a cytokine; an inhibitor of an immune inhibitory molecule; an agent that decreases the level or activity of a TREG cell; an agent that increase the proliferation and/or persistence of SIR-modified cells; a chemokine; an agent that increases the expression of SIR; an agent that allows regulation of the expression or activity of SIR; an agent that allows control over the survival and/or persistence of SIR-modified cells; an agent that controls the side effects of SIR-modified cells; a Brd4 inhibitor; an agent that delivers a therapeutic (e.g. sHVEM) or prophylactic agent to the site of the disease; an agent that increases the expression of the target antigen against which SIR is directed; and an adenosine A2a receptor antagonist, thereby treating the subject or preventing a disease in the subject.

The disclosure provides a method of treating or preventing a disease associated with expression of a disease-associated antigen in a subject, comprising administering to the subject an effective amount of an immune effector cell comprising a synthetic immune receptor (SIR) molecule, wherein: (i) the SIR molecule comprises one or more of T-cell receptor constant chains joined via an optional linker to one or more of antigen binding domains that bind to disease-associated antigen associated with the disease, and said disease-associated antigen is selected from a group consisting of: CD5, CD19; CD123; CD22; CD23, CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8)aNeu5Ac(2-3)bD- Galp(l-4)bDGlcp(l-l)Cer); TNF receptor family member B cell maturation (BCMA); Tn antigen (Tn Ag) or (GalNAcα-Ser/Thr)); prostate-specific membrane antigen (PSMA); Receptor tyrosine kinase-like orphan receptor 1 (ROR1); Fins Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-llRa); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha (FRa or FR1); Folate receptor beta (FRb); Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDClalp(l-4)bDGlcp(l-1)Cer); transglutaminase 5 (TGS5); high molecular weight-melanoma associated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ES0-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member lA (XAGEl); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCT A-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 lB 1 (CYPlB 1); CCCTC-Binding Factor (Zinc Finger Protein)-Like (BORIS or Brother of the Regulator oflm printed Sites), Squamous Cell Carcinoma Antigen Recognized By T Cells 3 (SART3); Paired box protein Pax-5 (PAX5); proacrosin binding protein sp32 (OY-TESl); lymphocyte-specific protein tyrosine kinase (LCK); A kinase anchor protein 4 (AKAP-4); synovial sarcoma, X breakpoint 2 (SSX2); Receptor for Advanced Glycation End products (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRl); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen); Fucosyl-GM1, PTK7, gpNMB, CDH1-CD324, DLL3, CD276/B7H3, IL11Ra, IL13Ra2, CD179b-IGLl1, TCR gamma-delta, NKG2D, CD32 (FCGR2A), Tim1-/HVCR1, CSF2RA (GM-CSFR-alpha), TGFbetaR2, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Chorionic Gonadotropin Hormone receptor (CGHR), CCR4, SLAMF6, SLAMF4, HIV1 envelope glycoprotein, HTLV1-Tax, CMV pp65, EBV-EBNA3c, KSHV K8.1, KSHV-gH, influenza A hemagglutinin (HA), GAD, PDL1, Guanylyl cyclase C (GCC), auto antibody to desmoglein 3 (Dsg3) and desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IGE, CD99, RAS G12V, Tissue Factor 1 (TF1), AFP, GPRC5D, claudin18.2 (CLD18A2 OR CLDN18A.2)), P-glycoprotein, STEAP1, LIV1, NECTIN-4, CRIPTO, GPA33, BST1/CD157, low conductance chloride channel, and antigen recognized by TNT antibody; and (ii) the antigen binding domain of the SIR molecule has a binding affinity at least 5-fold less than an antibody from which the antigen binding domain is derived.

In another or further embodiment of any of the foregoing methods or uses, the disease associated with expression of the disease associated antigen is selected from the group consisting of a proliferative disease, a precancerous condition, a cancer, and a non-cancer related indication associated with expression of the disease-associated antigen. In another or further embodiment of any of the foregoing methods or uses, the cancer is a hematologic cancer chosen from one or more of chronic lymphocytic leukemia (CLL), acute leukemias, acute lymphoid leukemia (ALL), B-cell acute lymphoid leukemia (B-ALL), T-cell acute lymphoid leukemia (T-ALL), chronic myelogenous leukemia (CML), B cell prolymphocytic leukemia, blastic plasmacytoid dendritic cell neoplasm, Burkitt's lymphoma, diffuse large B cell lymphoma, primary effusion lymphoma, follicular lymphoma, hairy cell leukemia, small cell- or a large cell-follicular lymphoma, malignant lymphoproliferative conditions, MALT lymphoma, mantle cell lymphoma, marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia, or preleukemia. In another or further embodiment of any of the foregoing methods or uses, the cancer is selected from the group consisting of colon cancer, rectal cancer, renal-cell carcinoma, liver cancer, non-small cell carcinoma of the lung, cancer of the small intestine, cancer of the esophagus, melanoma, bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, uterine cancer, carcinoma of the fallopian tubes, carcinoma of the endometrium, carcinoma of the cervix, carcinoma of the vagina, carcinoma of the vulva, Hodgkin's Disease, non-Hodgkin's lymphoma, cancer of the endocrine system, cancer of the thyroid gland, cancer of the parathyroid gland, cancer of the adrenal gland, sarcoma of soft tissue, cancer of the urethra, cancer of the penis, solid tumors of childhood, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, Merkel cell cancer, epidermoid cancer, squamous cell cancer, T-cell lymphoma, environmentally induced cancers, combinations of said cancers, and metastatic lesions of said cancers. In another or further embodiment of any of the foregoing methods or uses, the disease is associated with infection by a virus including but not limited to HIV1, HIV2, HTLV1, Epstein Barr virus (EBV), cytomegalovirus (CMV), adenovirus, adeno-associated virus, BK virus, Human Herpesvirus 6, Human Herpesvirus 8 influenza virus, parainfluenza virus, avian flu virus, MERS and SARS coronaviruses, Crimean Congo Hemorrhagic fever virus, rhino virus, enterovirus, Dengue virus, West Nile virus, Ebola virus, Marburg virus, Lassa fever virus, zika virus, RSV, measles virus, mumps virus, rhino virus, varicella virus, herpes simplex virus 1 and 2, varicella zoster virus, HIV-1, HTLV1, Hepatitis virus, enterovirus, hepatitis B virus, Hepatitis C virus, Nipah and Rift valley fever viruses, Japanese encephalitis virus, Merkel cell polyomavirus, or is associated with infection with *Mycobacterium tuberculosis*, atypical mycobacteria species, *Pneumocystis jirovecii*, toxoplasmosis, *Rickettsia, Nocardia, Aspergillus, Mucor*, or *Candida*. In another or further embodiment of any of the foregoing methods or uses, the disease is an immune or degenerative disease including but not limited to diabetes mellitus, multiple sclerosis, rheumatoid arthritis, pemphigus vulgaris, ankylosing spondylitis, Hoshimoto's thyroiditis, SLE, sarcoidosis, scleroderma, mixed connective tissue disease, graft versus host disease or Alzheimer's disease. In another or further embodiment of any of the foregoing methods or uses, (i) the protein phosphatase inhibitor is a SHP-1 inhibitor and/or an SHP-2 inhibitor; (ii) the kinase inhibitor is chosen from one or more of a CDK4 inhibitor, a CDK4/6 inhibitor, a mTOR inhibitor, a MNK inhibitor, or a dual P13K/mTOR inhibitor; (iii) the agent that inhibits the immune inhibitory molecule comprises an antibody or antibody fragment, an inhibitory nucleic acid, a clustered regularly interspaced short palindromic repeats (CRISPR), a transcription-activator like effector nuclease (TALEN), or a zinc finger endonuclease (ZFN) that inhibits the expression of the inhibitory molecule; (iv) the agent that decreases the level or activity of the T REG cells is chosen from cyclophosphamide, anti-GITR antibody, CD25-depletion, or a combination thereof, and/or (v) the Brd4 inhibitor is chosen from JQ1, MS417, OTXO15, LY 303511 and Brd4 inhibitor as described in US 20140256706 A1 or their derivatives. In another or further embodiment of any of the foregoing methods or uses, the immune inhibitory molecule is selected from the group consisting of PD1, PD-L1, CTLA-4, TIM-3, LAG-3, VISTA, BTLA, TIGIT, LAIR1, CD160, 2B4, TGFR beta, CEACAM-1, CEACAM-3, and CEACAM-5. In another or further embodiment of any of the foregoing methods or uses, the agent that inhibits the inhibitory molecule comprises a first polypeptide comprising an inhibitory molecule or a fragment thereof and a second polypeptide that provides a positive signal to the cell, and wherein the first and second polypeptides are expressed on the SIR-containing immune cells, wherein (i) the first polypeptide comprises PD1, PD-L1, CTLA-4, TIM-3, LAG-3, VISTA, BTLA, TIGIT, LAIR1, CD160, 2B4, TGFR beta, CEACAM-1, CEACAM-3, and CEACAM-5 or a fragment thereof, and/or (ii) the second polypeptide comprises an intracellular signaling domain comprising a primary signaling domain and/or a costimulatory signaling domain. In another or further embodiment of any of the foregoing methods or uses, the primary signaling domain comprises a functional domain of CD3 zeta; and/or the costimulatory signaling domain comprises a functional domain of a protein selected from 41BB, CD27 and CD28. In another or further embodiment of any of the foregoing methods or uses, the cytokine is chosen from IL-15 or IL-21, or both. In another or further embodiment of any of the foregoing methods or uses, the immune effector cell comprising the SIR molecule or molecules and the agent that increases the efficacy of the immune effector cell are administered substantially simultaneously or sequentially. In another or further embodiment of any of the foregoing methods or uses, the immune cell comprising the SIR molecule is administered in combination with a molecule that targets GITR and/or modulates GITR function. In another or further embodiment of any of the foregoing methods or uses, the molecule targeting GITR and/or modulating GITR function is administered prior to the SIR-expressing cell or population of cells, or prior to apheresis. In another or further embodiment of any of the foregoing methods or uses, the subject is a human.

The disclosure also provides a composition comprising at least one polynucleotide of the disclosure, a SIR polypeptide molecule of the disclosure, a vector of the disclosure or the cell of the disclosure and a pharmaceutically acceptable excipient.

The disclosure also provides a kit comprising at least one polynucleotide of the disclosure, a SIR polypeptide molecule of the disclosure, a vector of the disclosure or the cell of the disclosure and/or a composition of the disclosure.

The disclosure also provides a recombinant polynucleotide encoding a synthetic immune receptor comprising a sequence selected from the group consisting of SEQ ID NO: 900 to 2264, SEQ ID NO: 4531 to 6013, SEQ ID NO: 7519 to 8160, SEQ ID NO: 8803 to 9230, SEQ ID NO: 9659 to 9856, SEQ ID NO: 10474 to 12041, SEQ ID NO: 15786 to 16011, SEQ ID NO: 16240 to 16465, SEQ ID NO: 16694 to 16926, SEQ ID NO: 17162 to SEQ ID NO: 17394, SEQ ID NO: 17864 to 17979, SEQ ID NO: 18321 to 18322, SEQ ID NO: 18242 to 18259, SEQ ID NO: 18280 to 18588, SEQ ID NO: 18899, SEQ ID NO: 18915 to 18916 or a sequence with at least 75% identity to a nucleotide sequence encoding a synthetic immune receptor set forth in any one of SEQ ID NO: 900 to 2264, SEQ ID NO: 4531 to 6013, SEQ ID NO: 7519 to 8160, SEQ ID NO: 8803 to 9230, SEQ ID NO: 9659 to 9856, SEQ ID NO: 10474 to 12041, SEQ ID NO: 15786 to 16011, SEQ ID NO: 16240 to 16465, SEQ ID NO: 16694 to 16926, SEQ ID NO: 17162 to SEQ ID NO: 17394, SEQ ID NO: 17864 to 17979, SEQ ID NO: 18321 to 18322, SEQ ID NO: 18242 to 18259, SEQ ID NO: 18280 to 18588, SEQ ID NO: 18899 and SEQ ID NO: 18915 to 18916.

The disclosure also provides an amino acid sequence encoding a synthetic immune receptor polypeptide selected from the group consisting of SEQ ID NO: 3135 to 4498, SEQ ID NO: 6044 to 7518, SEQ ID NO: 8161 to 8802, SEQ ID NO: 9231 to 9658, SEQ ID NO: 9873 to 10070, SEQ ID NO: 12431 to 13998, SEQ ID NO: 16013 to 16238, SEQ ID NO: 16467 to 16692, SEQ ID NO:16928 to 17160, SEQ ID NO: 17396 to 17628, SEQ ID NO: 17981 to 18096, SEQ ID NO: 18239 to 18240, SEQ ID NO: 18261 to 18278, SEQ ID NO: 18590 to 18898, SEQ ID NO: 18900 and SEQ ID NO:18919 to 18920 or a sequence with at least 75% identity to an amino acid sequence encoding the synthetic immune receptor polypeptide set forth in any one of SEQ ID NO: 3135 to 4498, SEQ ID NO: 6044 to 7518, SEQ ID NO: 8161 to 8802, SEQ ID NO: 9231 to 9658, SEQ ID NO: 9873 to 10070, SEQ ID NO: 12431 to 13998, SEQ ID NO: 16013 to 16238, SEQ ID NO: 16467 to 16692, SEQ ID NO:16928 to 17160, SEQ ID NO: 17396 to 17628, SEQ ID NO: 17981 to 18096, SEQ ID NO: 18239 to 18240, SEQ ID NO: 18261 to 18278, SEQ ID NO: 18590 to 18898, SEQ ID NO: 18900 and SEQ ID NO:18919 to 18920.

The details of one or more embodiments of the invention are set forth in the accompanying drawings and the description below. Other features, objects, and advantages of the invention will be apparent from the description and drawings, and from the claims.

BRIEF DESCRIPTION OF THE DRAWINGS

FIG. 3A-Q show depictions of various formats that SIRs of the disclosure can have upon expression. In these depictions each TCR of the pair of TCRs is linked to a vH or vL binding domain. In other embodiments each TCR can be bound to a vHH domain rather than a vH or vL.

FIG. 4A-Q show depictions of various formats that SIRs of the disclosure can have upon expression. In these depictions one TCR of the pair of TCRs is linked to a vH or vL and the vH or vL is then linked to the opposite vH or vL. Although in (A) the vL is shown linked to the TCRb chain, it will be recognized that the orientation in all the depictions of (A)-(Q) could be swapped such that in (A) the vL is linked to the TCRa etc.

FIG. 5A-Q show depictions of various formats that SIRs of the disclosure can have upon expression. In these constructs, SIRs are based on a single domain antibody (vHH), which bind to only one of the two TCR constant chains and the other chain is left empty. An exemplary such construct is CD8SP-V5-[hTCRb-KACIAH]-F-P2A-CD8SP-Her3-17B05So-vHH-Myc-[hTCRa-CSDVP]-F-F2A-PAC [SEQ ID NO:1715]. Similar constructs can be made that are based on other non-immunoglobulin binding domains instead of a vHH domain. For example, such non-immunoglobulin binding domains may be based on affibodies, DARPINs, autoantigens (e.g. Dsg3), ligands (e.g. MPL or TRAIL) or receptors (e.g., CD16).

FIG. 6A-Q show depictions of various formats that SIRs of the disclosure can have upon expression. In these constructs, SIRs contain two different types of antigen binding domains that are structurally different. In one example, one antigen binding domain comprises of a single domain antibody (vHH), while the other antigen binding domain comprises of an scFV fragment in a vL-Linker-vH orientation or a vH-Linker-vL orientation. In another example, one antigen binding domain comprises of a single domain antibody (vHH), while the other antigen binding domain comprises of a receptor (e.g. CD16). In another example, one antigen binding domain comprises of a single domain antibody (vHH), while the other antigen binding domain comprises of an affibody. The advantage of using two different types of antigen binding domains is that they are less likely to interfere with each other. The first antigen binding domain (e.g. vHH) can be directed to one antigen and the second antigen binding domain (e.g., scFV fragment) can be targeted to another antigen. Alternatively, they both could be directed to the same antigen to increase the avidity.

FIG. 7A-Q show depictions of various formats that SIRs of the disclosure can have upon expression. In these constructs, SIRs are based on two scFV fragments. The two scFv fragments can be directed to two different antigens (e.g., CD8SP-CD19Bu12-scFv-V5-[hTCRb-KACIAH]-F-P2A-SP-CD20-2F2-scFv-Myc-[hTCRa-CSDVP]-F-F2A-PAC (040716-B04) [SEQ ID NO:1028]). Alternatively, they both could be directed to the same antigen to increase the avidity (e.g., CD8SP-CD19Bu12-scFv-V5-[hTCRb-KACIAH]-F-P2A-SP-FMC63-scFv-Myc-[hTCRa-CSDVP]-F-F2A-PAC (020216-B07) [SEQ ID NO:1026]). The format of scFV could be vH-linker-vL or vL-linker-vH.

FIG. 8A-T show depictions of various formats that SIRs of the disclosure can have upon expression. In some SIR constructs, a scFv fragment which consists of a signal peptide (e.g. derived from human CD8 signal peptide) fused in frame to a vL region, a Gly-Ser linker (GGGGSx3) and vH region is fused to either the Cα, Cβ, Pre-Cα, Cδ or Cγ chain and without a complementary chain.

FIG. 13A-B shows representative FACS analysis. (A) control Jurkat-NFAT-GFP cells or those expressing SIRs targeting CD19 (clone ID 051716-I08), MPL (Clone ID: 040716-A07) and BCMA (Clone ID: 011116-A07) were incubated with RAJI (top), HEL (middle) or U266 (bottom) cells, respectively. Induction of GFP expression is evident upon coculture of SIR-expressing Jurkat-NFAT-GFP cells with their respective target cells. (B) Jurkat cells expressing SIR targeting CDH6 (Clone ID: 051716-J05), CD276 (Clone ID: 050516-Q06) and Her2/neu (Clone ID: 050516-I03) were incubated with SKOV3 (top) and MC7 (middle and bottom) cells, respectively. Induction of GFP expression is evident upon coculture of SIR-expressing Jurkat-NFAT-GFP cells with their respective target cells.

DETAILED DESCRIPTION

Figure 1:
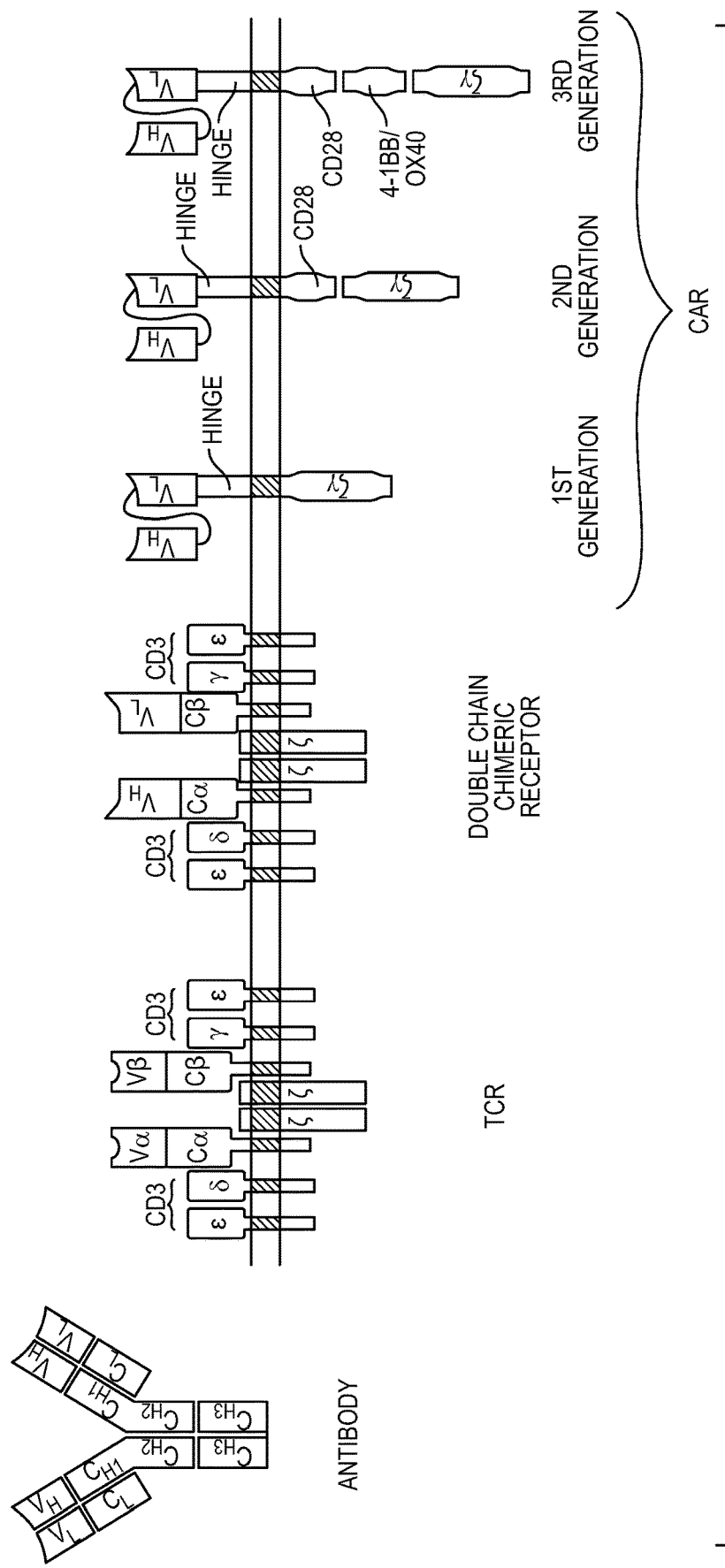
FIG. 1 shows a Schematic description of an antibody, a TCR, a double chain chimeric receptor and different generations of CAR.
Figure 2:
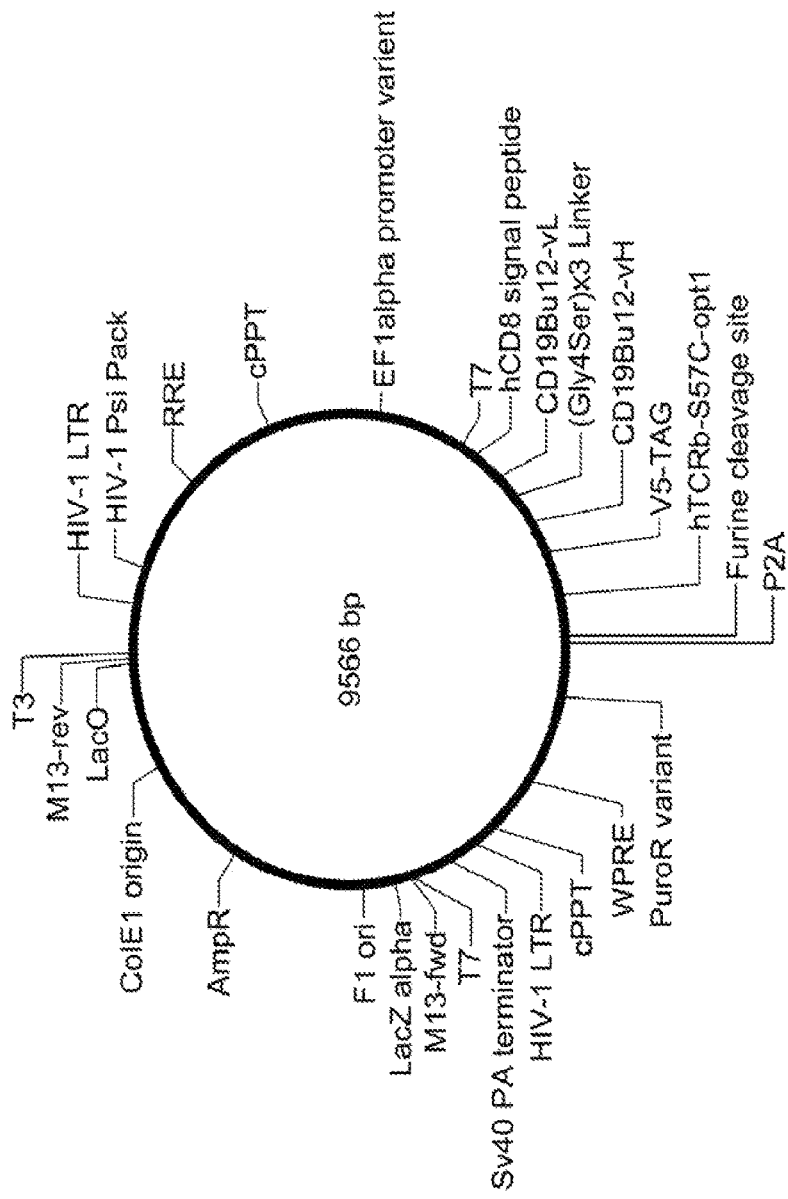
FIG. 2 shows an exemplary vector construct of the disclosure.

As used herein and in the appended claims, the singular forms "a," "an," and "the" include plural referents unless the context clearly dictates otherwise. Thus, for example, reference to "a cell" includes a plurality of such cells and reference to "the polynucleotide" includes reference to one or more polynucleotides and so forth.

Also, the use of "or" means "and/or" unless stated otherwise. Similarly, "comprise," "comprises," "comprising" "include," "includes," and "including" are interchangeable and not intended to be limiting.

It is to be further understood that where descriptions of various embodiments use the term "comprising," those skilled in the art would understand that in some specific instances, an embodiment can be alternatively described using language "consisting essentially of" or "consisting of."

Unless otherwise defined, all technical and scientific terms used herein have the same meaning as commonly understood by one of ordinary skill in the art to which this invention belongs. Allen et al., *Remington: The Science and Practice of Pharmacy* 22$^{nd}$ ed., Pharmaceutical Press (Sep. 15, 2012); Homyak et al., *Introduction to Nanoscience and Nanotechnology*, CRC Press (2008); Singleton and Sainsbury, *Dictionary of Microbiology and Molecular Biology* 3$^{rd}$ ed., revised ed., J. Wiley & Sons (New York, NY 2006); Smith, *March's Advanced Organic Chemistry Reactions, Mechanisms and Structure* 7$^{th}$ ed., J. Wiley & Sons (New York, NY 2013); Singleton, *Dictionary of DNA and Genome Technology* 3$^{rd}$ ed., Wiley-Blackwell (Nov. 28, 2012); and Green and Sambrook, *Molecular Cloning: A Laboratory Manual* 4th ed., Cold Spring Harbor Laboratory Press (Cold Spring Harbor, NY 2012), provide one skilled in the art with a general guide to many of the terms used in the present application. For references on how to prepare antibodies, see Greenfield, *Antibodies A Laboratory Manual* 2$^{nd}$ ed., Cold Spring Harbor Press (Cold Spring Harbor NY, 2013); Kohler and Milstein, *Derivation of specific antibody-producing tissue culture and tumor lines by cell fusion*, Eur. J. Immunol. 1976 July, 6(7):511-9; Queen and Selick, Humanized immunoglobulins, U.S. Pat. No. 5,585,089 (1996 December); and Riechmann et al., *Reshaping human antibodies for therapy*, Nature 1988 Mar. 24, 332(6162):323-7 All headings and subheading provided herein are solely for ease of reading and should not be construed to limit the invention. Although methods and materials similar or equivalent to those described herein can be used in the practice or testing of the invention, suitable methods and materials are described below. All publications, patent applications, patents, and other references mentioned herein are incorporated by reference in their entirety. In case of conflict, the present specification, including definitions, will control. In addition, the materials, methods, and specific examples are illustrative only and not intended to be limiting.

Synthetic immune receptors (SIRs) of the disclosure comprise an antigen binding domain (e.g., antibody or antibody fragment) that can, for example, bind to an antigen in a MHC-dependent or MHC-independent manner. Normally, peptides derived from endogenous proteins fill the pockets of Major histocompatibility complex (MHC) class I molecules, and are recognized by T cell receptors (TCRs) on CD8+T lymphocytes. The MHC class I complexes are constitutively expressed by all nucleated cells. In cancer, virus-specific and/or tumor-specific peptide/MHC complexes represent a unique class of cell surface targets for immunotherapy. TCR-like antibodies targeting peptides derived from viral or tumor antigens in the context of human leukocyte antigen (HLA)-A1 or HLA-A2 have been described (see, e.g., Sastry et al., J Viral. 2011 85(5):1935-1942; Sergeeva et al., Blood, 2011, 117(16):4262-4272;

Verma et al., J Immunol, 2010, 184(4):2156-2165; Willemsen et al., Gene Ther., 2001, 8(21):1601-1608; Dao et al., Sci Transl Med., 2013, 5(176):176ra33; Tassev et al., Cancer Gene Ther., 2012, 19(2):84-100). For example, TCR-like antibody can be identified from screening a library, such as a human scFv phage displayed library.

The disclosure generally provides synthetic immune receptors (SIRs) comprising antigen binding sites operably linked to a T-cell receptor domain. The disclosure further provides one or more recombinant nucleic acid constructs comprising sequences encoding a SIR, wherein the SIR comprises one or more antigen binding domains (e.g., antibody, antibody fragment, a non-immunoglobulin antigen binding domain, an autoantigen, a ligand or a receptor) that bind to an antigens or target molecule (as described further herein below), and are joined to one or more T cell receptor constant chains (including mutants or variants thereof). The antigen binding domain(s) of SIR bind specifically to one or more disease associated antigens or cognates described herein, wherein the coding sequence of each of the antigen binding domains is operably linked with a nucleic acid sequence encoding each of the T cell receptor constant chains to which it is joined such that the antigen binding domain is operably expressed with the T-cell constant chain. In some embodiments, a SIR may comprise a single antigen binding domain joined to a single T cell receptor constant chain. In some embodiments, a SIR comprises two antigen binding domains that are each joined to a separate T cell receptor constant chain. For example, antigen binding domain 1 is joined to the constant chain of T cell receptor alpha (TCRα) to constitute "functional unit 1" and antigen binding domain 2 is joined to the constant chain of T cell receptor β (TCRβ) to constitute "functional unit 2". The two functional units of such SIR are coexpressed in the same cell to become functionally active (e.g., heterodimerize). In some embodiments, a SIR comprises an antigen binding domain that is joined in frame to one T cell receptor constant chain (functional unit 1), but is coexpressed with a second T cell receptor constant chain. The purpose of the second T cell receptor constant chain in such SIRs is to facilitate the cell surface expression of functional unit 1 (e.g., antigen binding domain 1 joined to a T cell receptor constant chain). As such, the second T cell receptor constant chain may be expressed by itself or expressed as a fusion protein carrying an epitope tag (e.g., MYC, V5, AcV5, G4S×2, StrepTagII etc.) or expressed as a fusion protein carrying any irrelevant protein fragment (e.g. vL or vH fragment) which does not interfere with the assembly and function of the functional unit 1. As an example, a SIR may comprise an antigen binding domain 1 operably linked in frame to the constant chain of T cell receptor alpha (TCRα) and the empty (i.e., lacking an antigen binding domain) constant chain of T cell receptor β (TCRβ). The two functional units of such SIR are coexpressed in the same cell to become functionally active. In some embodiments, the two functional units of the SIR are coexpressed by transfection of a single polynucleotide that encodes for both functional units, while in other embodiments the two functional units are coexpressed by transfection of two different polynucleotides, each encoding for one functional unit. In some embodiments, the two functional units of the SIR are inserted at a single genomic locus, while in other embodiments the two functional units are inserted at two genomic loci. For example, in some embodiments, both functional units may be inserted at the TCRα constant chain (TRAC) locus and expressed as a single polynucleotide. In other embodiments, functional unit 1 may be inserted at the TCRα constant chain (TRAC) locus while functional unit 2 may be inserted at the TCR constant chain beta1 (TRBC1) locus. In some embodiments, the two functional units of the SIR are coexpressed by transfection of a single polynucleotide that encodes for both functional units, while in other embodiments the two functional units are coexpressed by transfection of two different polynucleotides, each encoding for one functional unit. In some embodiments, a SIR comprises an antigen binding domain that is joined in frame to one T cell receptor constant chain (functional unit 1), but is coexpressed with a second T cell receptor constant chain. The purpose of the second T cell receptor constant chain in such SIRs is to facilitate the cell surface expression of functional unit 1 (e.g., antigen binding domain 1 joined to a T cell receptor constant chain). As such, the second T cell receptor constant chain may be expressed by itself or expressed as a fusion protein carrying an epitope tag (e.g., MYC, V5, AcV5, G4S×2, StrepTagII etc.) or expressed as a fusion protein carrying any irrelevant protein fragment (e.g. vL or vH fragment) which does not interfere with the assembly and function of the functional unit 1. As an example, a SIR may comprise an antigen binding domain 1 operably linked in frame to the constant chain of T cell receptor alpha (TCRα) and the empty (i.e., lacking an antigen binding domain) constant chain of T cell receptor β (TCRβ). The two functional units of such SIR are coexpressed in the same cell to become functionally active. In some embodiments, the two functional units of the SIR are coexpressed using a single vector, while in other embodiments the two functional units are coexpressed in the same cells using different vectors. In some embodiments, the two functional units of the SIR are coexpressed by transfection of a single polynucleotide that encodes for both functional units, while in other embodiments the two functional units are coexpressed by transfection of two different polynucleotides, each encoding for one functional unit. Various configuration of SIRs of the disclosure are provided in FIGS. 3-8.

The disclosure provides a class of chimeric T cell receptor (Synthetic Immune Receptors (SIRs)), that can be used for adoptive cell therapy for the treatment of cancer, infectious, autoimmune and degenerative diseases. In contrast to the chimeric antigen receptors (CAR), the SIRs of the disclosure engage the full force of physiological T cell receptor signaling pathway and therefore are less likely to lead to complications associated with CARs, such as cytokine release syndrome, neurotoxicity, and lack of in vivo persistence. In contrast to the CARs, the SIRs of the disclosure have less tendency for self-aggregation of antigen binding domains, less chance of tonic signaling and less chance for early T cell exhaustion. The SIRs of the disclosure contain one or more antigen binding domains that are fused to the constant chains of TCRα (Cα), TCRβ (Cβ), TCRδ (Cδ), TCRγ (Cγ) or preTCRα (Cα) (including variants and mutants of any of the foregoing). The antigen binding domains can comprise an antibody or antibody fragment, the vL or/and vH fragments of an antibody, an scFv fragment derived from an antibody, a single domain antibody, an affibody, a DARPIN, any antigen binding ligand or receptor, an autoantigen, or any other non-immunoglobulin antigen binding fragment. The antigen binding domains may target a single antigen or multiple antigens (bispecific or multispecific SIRs). The TCR constant domains of SIRs can be expressed singly but are typically expressed in pairs (e.g., Cα with Cβ, or preCα with Cβ, or Cδ with Cγ, etc.) to facilitate optimum cell surface expression. The TCR constant chain fragments are typically codon optimized to allow optimal cell surface expression. The TCR constant fragments may carry additional mutations or substitutions to facilitate their optimal expression and pairing with the complementary chains and/or to reduce pairing with endogenous TCR chains and/or stabilize the interaction between the antigen binding domains. The SIRs may also express one or more additional domains (e.g. Myc, streptag, V5, FLAG, Ritx tag etc.) as fusion proteins. The SIR of the disclosure can be introduced into a cell using any number of techniques including, but not limited to, using lentiviral vectors, retroviral vectors, adeno-associated viral vectors, baculovirus vectors, sleeping beauty transposons, piggybac transposons or by mRNA transfection, or using a combination of the above methods. Optimized vectors for delivery of the SIRs are also disclosed. The SIRs of the disclosure can be expressed so that they are under the control of an endogenous promoter (e.g., TCRα or TCRβ promoter). In some embodiments, the SIR of the disclosure are expressed using foreign promoters (e.g. a CMV promoter). The SIRs of disclosure may also co-express additional modules, such as cDNAs encoding molecules that promote the expression or function of SIRs (e.g. CD3z, CD3ε, CD3delta, CD3z-41BB fusion protein etc.), that promote the proliferation, persistence, expansion and activation of T cells (e.g., 41BBL, CD40L, IL12f, K13, Tax, Tax2, MC159L, cFLIP, scFV targeting PD1, shRNA targeting BRD4 etc.), reduce toxicity (e.g. vHH or scFV targeting IL6R, IL6, TNFα etc.), selection markers (e.g. tEGFR, tEGFRvIII, tBCMA, tCD19 etc.) and/or suicide genes (e.g. icaspase 9, HSV-thymidine kinase). The SIRs of the disclosure can be expressed in immune effector cells (e.g., T cells) or in stem cells, including induced pluripotent stem cells (iPSC), that can give rise to immune effector cells. The disclosure also provides a subset of immune effector cells for expression of the SIRs and methods for activation and expansion of immune effector cells expressing the SIRs. The disclosure also describes agents that can be used to enhance the activity and persistence of immune effector cells expressing the SIRs or to reduce their toxicity. The disclosure describes a set of in vitro and in vivo assays that can be used to identify the SIRs suitable for various applications.

The term "about" when referring to a measurable value such as an amount, a temporal duration, and the like, is meant to encompass variations of 20% or in some instances ±10%, or in some instances ±5%, or in some instances ±1%, or in some instances ±0.1% from the specified value, as such variations are appropriate to perform the disclosed methods or describe the compositions herein. Moreover, any value or range (e.g., less than 20 or similar terminology) explicitly includes any integer between such values or up to the value. Thus, for example, "one to five mutations" explicitly includes 1, 2, 3, 4, and/or 5 mutations.

The term "accessory module" refers to any one or more of 41BBL, CD40L, K13, MC159, cFLIP-L/MRITα, cFLIP-p22, HTLV1 Tax, HTLV2 Tax, HTLV2 Tax-RS mutant, FKBPx2-K13, FKBPx2-HTLV2-Tax, FKBPx2-HTLV2-Tax-RS, IL6R-304-vHH-Alb8-vHH, IL12f, PD1-4H1 scFV, PD1-5C4 scFV, PD1-4H1-Alb8-vHH, PD1-5C4-Alb8-vHH, CTLA4-Ipilimumab-scFV, CTLA4-Ipilimumab-Alb8-vHH, IL6-19A-scFV, IL6-19A-scFV-Alb8-vHH, sHVEM, sHVEM-Alb8-vHH, hTERT, Fx06, CD3z, CD3z-GGGS-41BB, CD3-BBz, CD3-CD28z, CD3-CD28-Lck fusion protein, shRNA targeting Brd4 and combination thereof that can be coexpressed with a SIR. The accessory module can be co-expressed with the SIR using a single vector or using two or more different vectors. In one embodiment, the accessory modules comprises an amino acid sequence of SEQ ID NO: 3087 to 3117 (DNA coding sequences SEQ ID NOs:812-842) or a sequence with 80-99% identity thereof. In other embodiments, the nucleic acid sequence encoding the accessory modules comprises a sequence of SEQ ID NO: 812 to SEQ ID NO: 842, or a sequence with 80-99% identity thereof.

"Autoantibody" refers to an antibody that is produced by a B-cell specific for an autoantigen.

The term "antibody," as used herein, refers to a protein, or polypeptide sequence derived from an immunoglobulin molecule which specifically binds with an antigen. Antibodies can be monoclonal, or polyclonal, multiple or single chain, or intact immunoglobulins, and may be derived from natural sources or from recombinant sources. Antibodies can be tetramers of immunoglobulin molecules. The antibody may be 'humanized', 'chimeric' or non-human.

The term "antibody fragment" refers to at least one portion of an antibody, that retains the ability to specifically interact with (e.g., by binding, steric hindrance, stabilizing/destabilizing, spatial distribution) an epitope of an antigen. Examples of antibody fragments include, but are not limited to, Fab, Fab', F(ab'h, Fv fragments, scFv antibody fragments, disulfide-linked Fvs (sdFv), a Fd fragment consisting of the VH and CH1 domains, linear antibodies, single domain antibodies such as sdAb (either vL or vH), camelid vHH domains, multi-specific antibodies formed from antibody fragments such as a bivalent fragment comprising two Fab fragments linked by a disulfide bridge at the hinge region, and an isolated CDR or other epitope binding fragments of an antibody. An antigen binding fragment can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23:1126-1136, 2005). Antigen binding fragments can also be grafted into scaffolds based on polypeptides such as a fibronectin type III (Fn3)(see U.S. Pat. No. 6,703,199, which describes fibronectin polypeptide mini bodies).

The term "antibody heavy chain," refers to the larger of the two types of polypeptide chains present in antibody molecules in their naturally occurring conformations, and which normally determines the class to which the antibody belongs.

The term "antibody light chain," refers to the smaller of the two types of polypeptide chains present in antibody molecules in their naturally occurring conformations. Kappa (κ) and lambda (λ) light chains refer to the two major antibody light chain isotypes.

The term "anticancer effect" refers to a biological effect which can be manifested by various means, including but not limited to, a decrease in tumor volume, a decrease in the number of cancer cells, a decrease in the number of metastases, an increase in life expectancy, decrease in cancer cell proliferation, decrease in cancer cell survival, or amelioration of various physiological symptoms associated with the cancerous condition. An "anticancer effect" can also be manifested by the ability of the SIRs in prevention of the occurrence of cancer in the first place.

"Anticancer agent" refers to agents that inhibit aberrant cellular division and growth, inhibit migration of neoplastic cells, inhibit invasiveness or prevent cancer growth and metastasis. The term includes chemotherapeutic agents, biological agent (e.g., siRNA, viral vectors such as engineered MLV, adenoviruses, herpes virus that deliver cytotoxic genes), antibodies and the like.

The term "antigen" or "Ag" refers to a molecule that provokes an immune response. This immune response may involve either antibody production, or the activation of specific immunologically-competent cells, or both. The skilled artisan will understand that any macromolecule, including virtually all proteins or peptides, can serve as an antigen. Furthermore, antigens can be derived from recombinant or genomic DNA. A skilled artisan will understand that any DNA, which comprises a nucleotide sequences or a partial nucleotide sequence encoding a protein that elicits an immune response therefore encodes an "antigen" as that term is used herein. Furthermore, one skilled in the art will understand that an antigen need not be encoded solely by a full length nucleotide sequence of a gene. It is readily apparent that the disclosure includes, but is not limited to, the use of partial nucleotide sequences of more than one gene and that these nucleotide sequences are arranged in various combinations to encode polypeptides that elicit the desired immune response. Moreover, a skilled artisan will understand that an antigen need not be encoded by a "gene" at all. It is readily apparent that an antigen can be generated synthesized or can be derived from a biological sample, or might be macromolecule besides a polypeptide. Such a biological sample can include, but is not limited to a tissue sample, a tumor sample, a cell or a fluid with other biological components.

Non-limiting examples of target antigens include: CD5, CD19; CD123; CD22; CD30; CD171; CS1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8) aNeu5Ac(2-3)bDGalp(l-4)bDGlcp(l-l)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); Fins Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-llRa); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha (FRa or FR1); Folate receptor beta (FRb); Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); sialyl Lewis adhesion molecule (sLe); ganglioside GM3 (aNeu5Ac(2-3) bDClalp(l-4)bDGlcp(l-1)Cer); transglutaminase 5 (TGS5); high molecular weight-melanoma associated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ES0-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGEl); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; survivin; telomerase; prostate carcinoma tumor antigen-1 (PCTA-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 lB 1 (CYPlB 1); CCCTC-Binding Factor (Zinc Finger Protein)-Like (BORIS or Brother of the Regulator oflm printed Sites), Squamous Cell Carcinoma Antigen Recognized By T Cells 3 (SART3); Paired box protein Pax-5 (PAX5); proacrosin binding protein sp32 (OY-TESl); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRl); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen); Fucosyl-GM1, PTK7, gpNMB, CDH1-CD324, DLL3, CD276/B7H3, IL11Ra, IL13Ra2, CD179b-IGL11, TCRgamma-delta, NKG2D, CD32 (FCGR2A), Tn ag, Tim1-/HVCR1, CSF2RA (GM-CSFR-alpha), TGF-betaR2, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Gonadotropin Hormone receptor (CGHR or GR), CCR4, GD3, SLAMF6, SLAMF4, HIV1 envelope glycoprotein, HTLV1-Tax, CMV pp65, EBV-EBNA3c, KSHV K8.1, KSHV-gH, influenza A hemagglutinin (HA), GAD, PDL1, Guanylyl cyclase C (GCC), auto antibody to desmoglein 3 (Dsg3), auto antibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IgE, CD99, Ras G12V, Tissue Factor 1 (TF1), AFP, GPRC5D, Claudin18.2 (CLD18A2 or CLDN18A.2)), P-glycoprotein, STEAP1, Liv1, Nectin-4, Cripto, gpA33, BST1/CD157, low conductance chloride channel, and the antigen recognized by TNT antibody.

The term "antigen presenting cell" or "APC" refers to an immune system cell such as an accessory cell (e.g., a B-cell, a dendritic cell, and the like) that displays a foreign antigen complexed with major histocompatibility complexes (MHC's) on its surface. T-cells may recognize these complexes using their T-cell receptors (TCRs). APCs process antigens and present them to T-cells.

The term "anti-infection effect" refers to a biological effect which can be manifested by various means, including but not limited to, e.g., decrease in the titer of the infectious agent, a decrease in colony counts of the infectious agent, amelioration of various physiological symptoms associated with the infectious condition. An "anti-infectious effect" can also be manifested by the ability of the peptides, polynucleotides, cells and antibodies in prevention of the occurrence of infection in the first place.

The term "antitumor effect" or "anti-cancer effect" refers to a biological effect which can be manifested by various means, including but not limited to, e.g., a decrease in tumor volume, a decrease in the number of tumor cells, a decrease in tumor cell proliferation, or a decrease in tumor cell survival.

As used herein "affinity" is meant to describe a measure of binding strength. Affinity, in some instances, depends on the closeness of stereochemical fit between a binding agent and its target (e.g., between an antibody and antigen including epitopes specific for the binding domain), on the size of the area of contact between them, and on the distribution of charged and hydrophobic groups. Affinity generally refers to the "ability" of the binding agent to bind its target. There are numerous ways used in the art to measure "affinity". For example, methods for calculating the affinity of an antibody for an antigen are known in the art, including use of binding experiments to calculate affinity. Binding affinity may be determined using various techniques known in the art, for example, surface plasmon resonance, bio-layer interferometry, dual polarization interferometry, static light scattering, dynamic light scattering, isothermal titration calorimetry, ELISA, analytical ultracentrifugation, and flow cytometry. An exemplary method for determining binding affinity employs surface plasmon resonance. Surface plasmon resonance is an optical phenomenon that allows for the analysis of real-time biospecific interactions by detection of alterations in protein concentrations within a biosensor matrix, for example using the BIAcore system (Pharmacia Biosensor AB, Uppsala, Sweden and Piscataway, N.J.).

An "antigen binding domain" or "antigen binding module" or "antigen binding segment" refers to a polypeptide or peptide that due to its primary, secondary or tertiary sequence and or post-translational modifications and/or charge binds to an antigen with a high degree of specificity. The antigen binding domain may be derived from different sources, for example, an antibody, a non-immunoglobulin binding protein, a ligand or a receptor. The disclosure provides SIRs that comprise antigen binding domains that bind to one or more target antigens. The disclosure also provides SIRs that comprise antigen binding domains that are not derived from antibodies.

"Avidity" refers to the strength of the interaction between a binding agent and its target (e.g., the strength of the interaction between an antibody and its antigen target, a receptor and its cognate and the like). The avidity can be weak or strong. Methods for calculating the affinity of an antibody for an antigen are known in the art, including use of binding experiments to calculate affinity. Antibody activity in functional assays (e.g., flow cytometry assay) is also reflective of antibody affinity. Antibodies and affinities can be phenotypically characterized and compared using functional assays (e.g., flow cytometry assay).

The term "Association constant (Ka)" is defined as the equilibrium constant of the association of a receptor and ligand.

The term "autoantigen" refers to an endogenous antigen that stimulates production of an autoimmune response, such as production of autoantibodies. Autoantigen also includes a self-antigen or antigen from a normal tissue that is the target of a cell mediated or an antibody-mediated immune response that may result in the development of an autoimmune disease. Examples of autoantigens include, but are not limited to, desmoglein 1, desmoglein 3, and fragments thereof.

As used herein "beneficial results" may include, but are in no way limited to, lessening or alleviating the severity of the disease condition, preventing the disease condition from worsening, curing the disease condition, preventing the disease condition from developing, lowering the chances of a patient developing the disease condition and prolonging a patient's life or life expectancy.

As used herein, the term "binding domain" or "antibody molecule" refers to a protein, e.g., an immunoglobulin chain or fragment thereof, comprising at least one domain, e.g., immunoglobulin variable domain sequence that can bind to a target with affinity higher than a non-specific domain. The term encompasses antibodies and antibody fragments. In another embodiment, an antibody molecule is a multispecific antibody molecule, e.g., it comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In another embodiment, a multispecific antibody molecule is a bispecific antibody molecule. A bispecific antibody has specificity for two antigens. A bispecific antibody molecule is characterized by a first immunoglobulin variable domain sequence which has binding specificity for a first epitope and a second immunoglobulin variable domain sequence that has binding specificity for a second epitope.

"Binds the same epitope as" means the ability of an antibody, scFv, or other antigen binding domain to bind to a target antigen and having the same epitope as the exemplified antibody, scFv, or other antigen binding domain. As an example, the epitopes of the exemplified antibody, scFv, or other binding agent and other antibodies can be determined using standard epitope mapping techniques. Epitope mapping techniques, well known in the art include Epitope Mapping Protocols in Methods in Molecular Biology, Vol. 66 (Glenn E. Morris, Ed., 1996) Humana Press, Totowa, New Jersey For example, linear epitopes may be determined by, e.g., concurrently synthesizing large numbers of peptides on solid supports, the peptides corresponding to portions of the protein molecule, and reacting the peptides with antibodies while the peptides are still attached to the supports. Such techniques are known in the art and described in, e.g., U.S. Pat. No. 4,708,871; Geysen et al, (1984) Proc. Natl. Acad. Sci. USA 8:3998-4002; Geysen et al, (1985) Proc. Natl. Acad. Sci. USA 82:78-182; Geysen et al, (1986) Mol. Immunol. 23: 709-715. The epitope bound by the antigen binding domain of a SIR can be also determined by the Epitope Binning assay. Epitope binning is a competitive immunoassay used to characterize and then sort a library of monoclonal antibodies against a target protein. Antibodies against a similar target are tested against all other antibodies in the library in a pairwise fashion to see if antibodies block one another's binding to the epitope of an antigen. After each antibody has a profile created against all of the other antibodies in the library, a competitive blocking profile is created for each antibody relative to the others in the library. Closely related binning profiles indicate that the antibodies have the same or a closely related epitope and are "binned" together. Similarly, conformational epitopes are readily identified by determining spatial conformation of amino acids such as by, e.g., hydrogen/deuterium exchange, x-ray crystallography and two-dimensional nuclear magnetic resonance. See, e.g., Epitope Mapping Protocols, supra. Antigenic regions of proteins can also be identified using standard antigenicity and hydropathy plots, such as those calculated using, e.g., the Omiga version 1.0 software program available from the Oxford Molecular Group. This computer program employs the Hopp/Woods method, Hopp et al, (1981) Proc. Natl. Acad. Sci USA 78:3824-3828; for determining antigenicity profiles, and the Kyte-Doolittle technique, Kyte et al, (1982) J. Mol. Bioi. 157: 105-132; for hydropathy plots. To determine if selected monoclonal antibodies against a target (e.g., CD19) bind to unique epitopes, each antibody can be biotinylated using commercially available reagents (Pierce, Rockford, Ill.). Competition studies using unlabeled monoclonal antibodies and biotinylated monoclonal antibodies can be performed using CD19-extracellular domain coated-ELISA plates. Biotinylated mAb binding can be detected with a strep-avidin-alkaline phosphatase probe.

As used herein, the term "CDR" or "complementarity determining region" is intended to mean the non-contiguous antigen combining sites found within the variable region of both heavy and light chain polypeptides. These particular regions have been described by Kabat et al., J. Bioi. Chem. 252:6609-6616 (1977); Kabat et al., U.S. Dept. of Health and Human Services, "Sequences of proteins of immunological interest" (1991); Chothia et al., J. Mol. Bioi. 196: 901-917 (1987); and MacCallum et al., J. Mol. Bioi. 25 262:732-745 (1996), where the definitions include overlapping or subsets of amino acid residues when compared against each other. Nevertheless, application of either definition to refer to a CDR of an antibody or grafted antibodies or variants thereof is intended to be within the scope of the term as defined and used herein. As used herein, the different CDRs of an antibody could be also defined by a combination of the different definitions. For example, vHCDR1 could be defined based on Kabat and VHCDR2 could be defined based on Chothia. The amino acid residues which encompass the CDRs as defined by each of the above cited references are as follows:

CDR Definitions

|  | Kabat | Chothia | MacCallum |
|---|---|---|---|
| VHCDR1 | 31-35 | 26-32 | 30-35 |
| VHCDR2 | 50-65 | 53-55 | 47-58 |
| VHCDR3 | 95-102 | 96-10 | 193-101 |
| VLCDR1 | 24-34 | 26-32 | 30-36 |
| VLCDR2 | 50-56 | 50-52 | 46-55 |
| VLCDR3 | 89-97 | 91-96 | 89-96 |

(Residue Numbers correspond to the identified reference).

The SEQ IDs of the CDRs of the different vL and vH segments that constitute the antigen binding domains of the SIRs of the disclosure targeting different antigens are provided in Table 5.

In some embodiments, reference to an antigen-binding module (such as a Fab-like or Fv-like antigen-binding module) that specifically binds to a target antigen means that the antigen-binding module binds to the target antigen with (a) an affinity that is at least about 10 (e.g., about 10, 20, 30, 40, 50, 75, 100, 200, 300, 400, 500, 750, 1000 or more) times its binding affinity for other molecules; or (b) a $K_d$ no more than about $1/10$ (e.g., $1/10$, $1/20$, $1/30$, $1/40$, $1/50$, $1/75$, $1/100$, $1/200$, $1/300$, $1/400$, $1/500$, $1/750$, $1/1000$ or less) times its $K_d$ for binding to other molecules. Binding affinity can be determined by methods known in the art, such as ELISA, fluorescence activated cell sorting (FACS) analysis, or radioimmunoprecipitation assay (RIA). $K_d$ can be determined by methods known in the art, such as surface plasmon resonance (SPR) assay utilizing, for example, Biacore instruments, or kinetic exclusion assay (KinExA) utilizing, for example, Sapidyne instruments.

"Cancer" and "cancerous" refer to or describe the physiological condition in mammals that is typically characterized by unregulated cell growth. Examples of cancer include, but are not limited to B-cell lymphomas (Hodgkin's lymphomas and/or non-Hodgkins lymphomas), T cell lymphomas, myeloma, myelodysplastic syndrome, skin cancer, brain tumor, breast cancer, colon cancer, rectal cancer, esophageal cancer, anal cancer, cancer of unknown primary site, endocrine cancer, testicular cancer, lung cancer, hepatocellular cancer, gastric cancer, pancreatic cancer, cervical cancer, ovarian cancer, liver cancer, bladder cancer, cancer of the urinary tract, cancer of reproductive organs thyroid cancer, renal cancer, carcinoma, melanoma, head and neck cancer, brain cancer (e.g., glioblastoma multiforme), prostate cancer, including but not limited to androgen-dependent prostate cancer and androgen-independent prostate cancer, and leukemia. Other cancer and cell proliferative disorders will be readily recognized in the art. The terms "tumor" and "cancer" are used interchangeably herein, e.g., both terms encompass solid and liquid, e.g., diffuse or circulating, tumors. As used herein, the term "cancer" or "tumor" includes premalignant, as well as malignant cancers and tumors.

"Chemotherapeutic agents" are compounds that are known to be of use in chemotherapy for cancer. Non-limiting examples of chemotherapeutic agents can include alkylating agents such as thiotepa and CYTOXAN® cyclosphosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethiylenethiophosphoramide and trimethylolomelamine; acetogenins (especially bullatacin and bullatacinone); a camptothecin (including the synthetic analogue topotecan); bryostatin; callystatin; CC-1065 (including its adozelesin, carzelesin and bizelesin synthetic analogues); cryptophycins (particularly cryptophycin 1 and cryptophycin 8); dolastatin; duocarmycin (including the synthetic analogues, KW-2189 and CB1-TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, and ranimnustine; antibiotics such as the enediyne antibiotics (e.g., calicheamicin, especially calicheamicin gamma1I and calicheamicin omega1I (see, e.g., Agnew, Chem. Intl. Ed. Engl., 33: 183-186 (1994)); dynemicin, including dynemicin A; bisphosphonates, such as clodronate; an esperamicin; as well as neocarzinostatin chromophore and related chromoprotein enediyne antibiotic chromophores), aclacinomysins, actinomycin, authramycin, azaserine, bleomycins, cactinomycin, carabicin, caminomycin, carzinophilin, chromomycinis, dactinomycin, daunorubicin, detorubicin, 6-diazo-5-oxo-L-norleucine, ADRIAMYCIN® doxorubicin (including morpholino-doxorubicin, cyanomorpholino-doxorubicin, 2-pyrrolino-doxorubicin and deoxydoxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elformithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK® polysaccharide complex (JHS Natural Products, Eugene, Oreg.); razoxane; rhizoxin; sizofuran; spirogermanium; tenuazonic acid; triaziquone; 2,2',2"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g., TAXOL® paclitaxel (Bristol-Myers Squibb Oncology, Princeton, N.J.), ABRAXANE® Cremophor-free, albumin-engineered nanoparticle formulation of paclitaxel (American Pharmaceutical Partners, Schaumberg, Ill.), and TAXOTERE® doxetaxel (Rhone-Poulenc Rorer, Antony, France); chloranbucil; GEMZAR® gemcitabine; 6-thioguanine; mercaptopurine; methotrexate; platinum analogs such as cisplatin, oxaliplatin and carboplatin; vinblastine; platinum; etoposide (VP-16); ifosfamide; mitoxantrone; vincristine; NAVELBINE; vinorelbine; novantrone; teniposide; edatrexate; daunomycin; aminopterin; xeloda; ibandronate; irinotecan (Camptosar, CPT-11) (including the treatment regimen of irinotecan with 5-FU and leucovorin); topoisomerase inhibitor RFS 2000; difluoromethylomithine (DMFO); retinoids such as retinoic acid; capecitabine; combretastatin; leucovorin (LV); oxaliplatin, including the oxaliplatin treatment regimen (FOLFOX); lapatinib (Tykerb); inhibitors of PKC-alpha, Raf, H-Ras, EGFR (e.g., erlotinib (Tarceva®)) and VEGF-A that reduce cell proliferation and pharmaceutically acceptable salts, acids or derivatives of any of the above or combinations thereof.

"Chimeric antigen receptors" (CAR) are artificial T cell receptors contemplated for use as a therapy for cancer, using a technique called adoptive cell transfer. The essential antigen-binding, signaling, and stimulatory functions of the complex have been reduced by genetic recombination methods to a single polypeptide chain, generally referred to as a Chimeric Antigen Receptor (CAR). See, e.g., Eshhar, U.S. Pat. No. 7,741,465; Eshhar, U.S. Patent Application Publication No. 2012/0093842. CARs are constructed specifically to stimulate T cell activation and proliferation in response to a specific antigen to which the CAR binds. The term "Chimeric Antigen Receptor" or alternatively a "CAR" refers to a set of polypeptides, typically two in the simplest embodiments, which when expressed in an immune effector cell, provides the cell with specificity for a target cell, typically a cancer cell, and with intracellular signal generation. In some embodiments, a CAR comprises at least an extracellular antigen binding domain, a transmembrane domain and a cytoplasmic signaling domain (also referred to herein as "an intracellular signaling domain") comprising a functional signaling domain derived from a stimulatory molecule and/or costimulatory molecule. In some aspects, the set of polypeptides are contiguous with each other. In one aspect, the stimulatory molecule is the zeta chain associated with the T cell receptor complex. In one aspect, the cytoplasmic signaling domain further comprises one or more functional signaling domains derived from at least one costimulatory molecule as defined below. In one aspect, the costimulatory molecule is chosen from the costimulatory molecules described herein, e.g., 4-1BB (i.e., CD137), CD27 and/or CD28. In one aspect the CAR comprises an optional leader sequence at the amino-terminus (N-ter) of the CAR fusion protein. In one aspect, the CAR further comprises a leader sequence at the N-terminus of the extracellular antigen binding domain, wherein the leader sequence is optionally cleaved from the antigen binding domain (e.g., a scFv) during cellular processing and localization of the CAR to the cellular membrane. Typically "CAR-T cells" are used, which refer to T-cells that have been engineered to containing a chimeric antigen receptor. Thus, T lymphocytes bearing such CARs are generally referred to as CAR-T lymphocytes.

"Codon optimization" or "controlling for species codon bias" refers to the preferred codon usage of a particular host cell. As will be understood by those of skill in the art, it can be advantageous to modify a coding sequence to enhance its expression in a particular host. The genetic code is redundant with 64 possible codons, but most organisms typically use a subset of these codons. The codons that are utilized most often in a species are called optimal codons, and those not utilized very often are classified as rare or low-usage codons.

Optimized coding sequences containing codons preferred by a particular prokaryotic or eukaryotic host (see also, Murray et al. (1989) Nucl. Acids Res. 17:477-508) can be prepared, for example, to increase the rate of translation or to produce recombinant RNA transcripts having desirable properties, such as a longer half-life, as compared with transcripts produced from a non-optimized sequence. Translation stop codons can also be modified to reflect host preference. Those of skill in the art will recognize that, due to the degenerate nature of the genetic code, a variety of DNA compounds differing in their nucleotide sequences can be used to encode a given polypeptide of the disclosure.

As used herein, "co-express" refers to expression of two or more genes. Genes may be nucleic acids encoding, for example, a single protein or a chimeric protein as a single polypeptide chain. The SIR described herein may be encoded by a single polynucleotide chain and synthesized as single polypeptide chain, which is subsequently cleaved into different polypeptides, each representing a distinct functional unit. In some embodiments, where the SIR consists of two or more functional polypeptide units, the different functional units are coexpressed using one or more polynucleotide chains. In another embodiment, the different polynucleotide chains are linked by nucleic acid sequences that encode for cleavable linkers (e.g. T2A, F2A, P2A, E2A etc.). In another embodiment, a Ser-Gly-Ser-Gly (SGSG) motif (SEQ ID NO: 3065) is also added upstream of the cleavable linker sequences to enhance the efficiency of cleavage. A potential drawback of the cleavable linkers is the possibility that the small 2A tag left at the end of the N-terminal protein may affect protein function or contribute to the antigenicity of the proteins. To overcome this, in some embodiments, a furine cleavage site (RAKR) (SEQ ID NO: 3066) is added upstream of the SGSG motifs to facilitate cleavage of the residual 2A peptide following translation. The polynucleotides encoding the different units of a SIR may be linked by IRES (Internal Ribosomal Entry Site) sequences. Alternately, the different functional units of a SIR are encoded by two different polynucleotides that are not linked via a linker but are instead encoded by, for example, two different vectors. The nucleic acid sequences of cleavable linkers and Furine cleavage sites are provided in SEQ ID NO: 780 to SEQ ID NO: 790.

A "conservative substitution" or "conservative sequence modifications" refers to amino acid modifications that do not significantly affect or alter the binding characteristics or function of the encoded protein. For example, "conservative sequence modifications" refers to amino acid modifications that do not significantly affect or alter the binding characteristics or function of the TCR constant chain, antibody, antibody fragment, or non-immunoglobulin binding domains. Such conservative modifications include amino acid substitutions, additions and deletions. Modifications can be introduced into a TCR constant chain, antibody or antibody fragment, the non-immunoglobulin binding domain or other proteins or polypeptides of the disclosure by standard techniques known in the art, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within a SIR of the disclosure can be replaced with other amino acid residues from the same side chain family and the altered SIR can be tested using the binding and/or functional assays described herein.

The term "constant region of T cell receptor-alpha" or "constant chain of T cell receptor-alpha" or "TCRα" or "Cα" is defined as the protein provided as SEQ ID NO: 3010 or the equivalent residues (i.e., a homolog) from a non-human species, e.g., mouse, rodent, monkey, ape and the like. The disclosure also provides certain mutations to TCRα polypeptides. For example, sites of mutation in Cα that demonstrate increased expression and decreased mispairing of synthetic immune receptors (SIRs) of the disclosure are located at positions 91, 92, 93, and 94 of SEQ ID NO 3010. A SIR with a Thr 48 Cys (T48C) mutation in Cα and a Ser-57-Cys (S57C) mutation in Cβ1 or Cβ2 chain (described more fully elsewhere herein) results in an additional disulfide bond between the two TCR constant chains (α and β). This, in turn, results in reduced mispairing with endogenous TCR chains in an immune cell and enhanced functionality. Similarly, a SIR with a Ser 61 Arg (S61R) mutation in Cα and an Arg 79 Gly (R79G) mutation in Cβ1 or Cβ2 chain (described more fully elsewhere herein) results in reduced mispairing with the endogenous TCR chains and enhanced functionality due to a "knob and hole" design for pairing. The disclosure provides Cα polypeptides having one or more or all of the mutations according to Table 1 below.

TABLE 1

Mutations according to the disclosure in the human constant TCR-alpha region (Cα) of SIR

| Position (SEQ ID NO: 3010) | Amino acid in wild-type | Mutation | TYPE |
|---|---|---|---|
| 10 | Y | C | disulfide bond |
| 15 | S | C | disulfide bond |
| 45 | T | C | disulfide bond |
| 48 | T | C | disulfide bond |
| 61 | S | R | Knob into Hole |
| 91 | P | S | Murinization |
| 92 | E | D | Murinization |
| 93 | S | V | Murinization |
| 94 | S | P | Murinization |

The human genome encodes for two highly homologous TCR beta constant chains; TCR beta1 (TCRβ1 or TCRb1 or cβ1) and TCR beta 2 (TCRβ2 or TCRb2 or cβ2). The SIRs of the disclosure can comprise either of these two chains. Similarly, either TCR beta1 or TCR beta2 chains of other mammalian species can be used in the methods of the disclosure to make SIRs The term "constant chain of T cell receptor-beta 1" or "constant region of T cell receptor-beta 1" (TCR-beta1 or TCRβ1 or TCRb1 or hTCR-beta1 or Cβ1) is defined as a protein provided as SEQ ID NO: 3024 or the equivalent residues (i.e., a homolog) from a non-human species, e.g., mouse, rodent, monkey, ape and the like.

The term "constant chain of T cell receptor-beta 2" or "constant region of T cell receptor-beta 2" (TCR-beta2 or TCRβ2 or TCRb2 or Cβ2) is defined as the protein provided as SEQ ID NO: 3025 or the equivalent residues (i.e., a homolog) from a non-human species, e.g., mouse, rodent, monkey, ape and the like.

The term "constant chain of T cell receptor-beta" or "constant region of T cell receptor-beta" (TCR-beta or TCRβ or TCRb or Cβ)" is defined as the protein provided as SEQ ID NO: 3024 or SEQ ID NO: 3025 or the equivalent residues (i.e., a homolog) from a non-human species, e.g., mouse, rodent, monkey, ape and the like.

The protein sequences for both Cβ2 (SEQ ID NO: 3025) and Cβ1 (SEQ ID NO: 3024) are known. Differences between the sequences of Cβ2 and 31 are easily identified by alignment of the sequences using typical and ordinary skill in the art. The disclosure also provides certain mutations to TCRβ's. For example, sites of mutation in Cos that demonstrate increased expression and decreased mispairing of synthetic immune receptors (SIRs) with the endogenous TCRα chains are provided herein. These mutation sites in Cβ1 and Cβ2 are located at positions 18, 22, 57, 79 133, 136, and 139 of SEQ ID NOs 3025 and 3024 and are summarized in the Tables 2 and 3 below. The mutation sites in Cβ1 and Cβ2 are identical in their positions. The only difference between the two sequences is that a mutation at position 136. At this position, a glutamic acid (E) is present in Cβ2, whereas a valine is present in Cβ1.

TABLE 2

Mutations according to the disclosure in the human constant TCR-beta region1 (Cβ1) of SIR

| Position (SEQ ID NO: 3024) | Amino acid in wild-type | Mutation | TYPE |
| --- | --- | --- | --- |
| 15 | E | C | disulfide bond |
| 17 | S | C | disulfide bond |
| 18 | E | K or R | Murinization |
| 22 | S | A | Murinization |
| 57 | S | C | disulfide bond |
| 59 | D | C | disulfide bond |
| 77 | S | C | disulfide bond |
| 79 | R | G | Knob into Hole |
| 133 | F | I | Murinization |
| 136 | V | A | Murinization |
| 139 | Q | H | Murinization |

TABLE 3

Mutations according to the disclosure in the human constant TCR-beta region2 (Cβ2) of SIR

| Position (SEQ ID NO: 3025) | Amino acid in wild-type | Mutation | TYPE |
| --- | --- | --- | --- |
| 15 | E | C | disulfide bond |
| 17 | S | C | disulfide bond |
| 18 | E | K or R | Murinization |
| 22 | S | A | Murinization |
| 57 | S | C | disulfide bond |
| 59 | D | C | disulfide bond |
| 77 | S | C | disulfide bond |
| 79 | R | G | Knob into Hole |
| 133 | F | I | Murinization |
| 136 | E | A | Murinization |
| 139 | Q | H | Murinization |

The term "constant chain of preTCRa" (preTCR-alpha or preTCRα or preTCRa or preCα) or "constant region of preTCRa" is defined as the proteins provided as SEQ ID NO: 3046 or SEQ ID NO: 3047 or the equivalent residues (i.e., a homolog) from a non-human species, e.g., mouse, rodent, monkey, ape and the like.

The term "constant chain of preTCRa-Del48" (preTCR-alpha-Del48 or preTCRα-Del48 or preTCRa-Del48 or preCα-Del48) or "constant region of preTCRa-Del48" is defined as the protein provided as SEQ ID NO: 3048 or the equivalent residues (i.e., a homolog) from a non-human species, e.g., mouse, rodent, monkey, ape and the like.

The term "constant chain of TCR-gamma" or "constant region of TCR-gamma" (TCR-gamma or TCRγ or TCRg or TCR-gamma1 or TCRγ1 or TCRg1 or Cγ) is defined as the protein provided as SEQ ID NO: 3049 or the equivalent residues (i.e., a homolog) from a non-human species, e.g., mouse, rodent, monkey, ape and the like.

The term "constant chain of TCR-delta" or "constant region of TCR-delta" (TCR-delta or TCRδ or TCRd or Cδ) is defined as the proteins provided as SEQ ID NO: 3051 or SEQ ID NO: 3052 or the equivalent residues (i.e., a homolog) from a non-human species, e.g., mouse, rodent, monkey, ape and the like.

It will be recognized that proteins can have identity or homology to one another and retain similar or identical functions. The disclosure includes TCR constant regions that have 85%, 90%, 95%, 97%, 98%, 98.5%, 99% or 99.9% identity to any of the sequences described herein while retaining the biological activity.

Accordingly, the disclosure provides a T-cell receptor constant chain having a sequence selected from the group consisting of: (a) an amino acid sequence that is at least 98% identical to SEQ ID NO:3010 and which can have one or more mutations at positions 61, 91, 92, 93, and/or 94; (b) an amino acid sequence that is at least 98% identical to SEQ ID NO:3024 and can have one or more mutations at positions 18, 22, 57, 79, 133, 136 and/or 139; (c) an amino acid sequence that is at least 98% identical to SEQ ID NO:3025 and can have one or more mutations at position 18, 22, 57, 79, 133, 136 and/or 139; (d) an amino acid sequence that is at least 98% identical to SEQ ID NO:3046 or 3047; (e) an amino acid sequence that is at least 98% identical to SEQ ID NO:3048; (f) an amino acid sequence that is at least 98% identical to SEQ ID NO:3049; and (g) an amino acid sequence that is at least 98% identical to SEQ ID NO:3051 or 3052. The T-cell receptor constant chains of any of (a)-(g) retain at least one biological activity of the wild-type T-cell receptor constant chain to which it has identity or homology.

The term a "costimulatory molecule" refers to a cognate binding partner on aT cell that specifically binds with a costimulatory ligand, thereby mediating a costimulatory response by the T cell, such as, but not limited to, proliferation. Costimulatory molecules are cell surface molecules other than antigen receptors or their ligands that are contribute to an efficient immune response. Costimulatory molecules include, but are not limited to an MHC class I molecule, BTLA and a Toll ligand receptor, as well as OX40, CD27, CD28, CD8, ICAM-1, LFA-1 (CD11a/CD18), ICOS (CD278), and 4-1BB (CD137). Further examples of such costimulatory molecules include CD8, ICAM-1, GITR, BAFFR, HVEM (LIGHTR), SLAMF7, NKp80 (KLRF1), NKp44, NKp30, NKp46, CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CDlld, ITGAE, CD103, ITGAL, CDlla, LFA-1, ITGAM, CDllb, ITGAX, CDllc, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRT AM, Ly9 (CD229), CD160 (BY55), PSGL1, CDlOO (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83. A costimulatory intracellular signaling domain can be the intracellular portion of a costimulatory molecule. A costimulatory molecule can be represented in the following protein families: TNF receptor proteins, Immunoglobulin-like proteins, cytokine receptors, integrins, signaling lymphocytic activation molecules (SLAM proteins), and activating NK cell receptors. Examples of such molecules include CD27, CD28, 4-1BB (CD137), OX40, GITR, CD30, CD40, ICOS, BAFFR, HVEM, ICAM-1, lymphocyte function-associated antigen-1 (LFA-1), CD2, CD8, CD7, CD287, LIGHT, NKG2C, NKG2D, SLAMF7, NKp80, NKp30, NKp44, NKp46, CD160, B7-H3, and a ligand that specifically binds with CD83, and the like. The intracellular signaling domain can comprise the entire intracellular portion, or the entire native intracellular signaling domain, of the molecule from which it is derived, or a functional fragment or derivative thereof.

The term "cTCR" refers to a wild-type TCR nucleic acid coding sequence and the corresponding wild-type TCR protein linked to an antigen binding domain. cTCRs are used in some embodiments and reference controls. For example, a cTCR having a CD19 binding domain and a CD19-SIR (comprising a mutant TCR chain and CD19 binding domain) will have different expression and/or difference binding affinities to the target antigen.

The term "degenerative disorders" refers to a disease that is the result of a continuous process based on degenerative cell changes, affecting tissues or organs, which will increasingly deteriorate over time, whether due to normal bodily wear or lifestyle choices such as exercise or eating habits. Exemplary degenerative diseases include Alzheimer's disease, Charcot-Marie-Tooth disease, Creutzfeldt-Jakob disease, Friedreich's ataxia, Diabetes mellitus (type II), and Atherosclerosis.

"Derived from" as that term is used herein, indicates a relationship between a first and a second molecule. It generally refers to structural similarity between the first molecule and a second molecule and does not connotate or include a process or source limitation on a first molecule that is derived from a second molecule. For example, in the case of an antigen binding domain that is derived from an antibody molecule, the antigen binding domain retains sufficient antibody structure such that is has the required function, namely, the ability to bind to an antigen. It does not connotate or include a limitation to a particular process of producing the antibody, e.g., it does not mean that, to provide the antigen binding domain, one must start with an antibody sequence and delete unwanted sequence, or impose mutations, to arrive at the antigen binding domain.

The phrase "disease associated with expression of a target antigen" or "disease associated antigen as described herein" includes, but is not limited to, a disease associated with expression of a target antigen as described herein or condition associated with cells which express a target antigen as described herein including, e.g., proliferative diseases such as a cancer or malignancy or a precancerous condition such as a myelodysplasia, a myelodysplastic syndrome or a pre leukemia; or a noncancer related indication associated with cells which express a target antigen as described herein. In one aspect, a cancer associated with expression of a tumor antigen as described herein is a hematological cancer. In one aspect, a cancer associated with expression of a tumor antigen as described herein is a solid cancer. Further diseases associated with expression of a tumor antigen described herein include, but are not limited to, atypical and/or non-classical cancers, malignancies, precancerous conditions or proliferative diseases associated with expression of a tumor antigen as described herein. Non-cancer related indications associated with expression of a target antigen as described herein include, but are not limited to, e.g., autoimmune disease, (e.g., lupus), inflammatory disorders (allergy and asthma) and transplantation. In some embodiments, the target antigen-expressing cells express, or at any time expressed, mRNA encoding the target antigen. In another embodiment, the target antigen-expressing cells produce the target antigen protein (e.g., wild-type or mutant), and the target antigen protein may be present at normal levels or reduced levels. In another embodiment, the target antigen-expressing cells produced detectable levels of a target antigen protein at one point, and subsequently produced substantially no detectable target antigen protein.

"Disease targeted by genetically modified cells" as used herein encompasses the targeting of any cell involved in any manner in any disease by a genetically modified cells that hones to the disease or a target tissue or cell type, irrespective of whether the genetically modified cells target diseased cells or healthy cells to effectuate a therapeutically beneficial result.

The term "Dissociation constant (Kd)" is defined as the equilibrium constant of the dissociation of a receptor-ligand interaction.

As used herein a "diverse set of SIRs" or "diverse set of synthetic immune receptors" refers to a plurality of SIRs having the same binding domain linked to a diverse set of T cell receptor constant chains wherein each construct comprising a binding domain and a different T cell constant chain provide a diverse range of binding to a target antigen and/or varied expression levels. For example, depending upon the mutation composition of the constant domain (e.g., mutant TCRa+TCRb), the binding affinity of the binding domain to its target varies. In some embodiments, a SIR of the disclosure (single strand or heterodimer) comprises a binding affinity that is greater than a wild-type TCR (e.g., cTCR) with the same binding domain. In one embodiment a SIR has a higher expression level than a cTCR by at least 1.25 fold to about 10,000 fold higher (and any number in between), wherein the SIR and cTCR differ only in the mutation in the TCR domain. In another embodiment, a SIR has a binding affinity for a target that is at least 1.5 fold higher to about 10,000 fold higher than a cTCR having a binding domain to the same antigen. In yet another embodiment, the SIR has a higher binding affinity than a cTCR to the same antigen, but less than a chimeric antigen receptor (CAR) having the same binding domain. In some embodiments, the binding of a SIR expressing effector cell to the target antigen is at least 1.25-fold more than the binding of a corresponding cTCR-expressing effector cell but less than 100,000 fold more than the corresponding cTCR. In some embodiment, the antigen binding domain has a disassociation constant ($K_D$, reflecting its binding affinity) from between about $10^{-4}$ M to $10^{-8}$ M. In some embodiments, the antigen binding domain binds to one or more of the antigens recited above. In some embodiment, the antigen binding domain has a $K_D$ of between about $10^{-4}$ M to $10^{-8}$ M, e.g., between about $10^{-5}$ M to $10^{-7}$M, e.g., between about $10^{-5}$ M to $10^{-6}$M, for the target antigen. In one embodiment, the binding affinity of the antigen binding domain is at least five-fold, 10-fold, 20-fold, 30-fold, 50-fold, 100-fold or 1,000-fold less than a reference antibody. In one embodiment, the encoded antigen binding domain has a binding affinity at least 5-fold less than a reference antibody. In some embodiments, the reference antibody is an antibody from which the antigen binding domain is derived.

As used herein, an "epitope" is defined to be the portion of an antigen capable of eliciting an immune response, or the portion of an antigen that binds to an antibody or antibody fragment. Epitopes can be a protein sequence or subsequence.

The term "expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, including cosmids, plasmids (e.g., naked or contained in liposomes) and viruses (e.g., lentiviruses, retroviruses, adenoviruses, and adena-associated viruses) that incorporate the recombinant polynucleotide.

The term "functional polypeptide unit (FPU)" of a SIR refers to a polypeptide comprising an amino terminal signal sequence functionally linked to a TCR constant chain. In some embodiments, the FPU contains an antigen binding domain located between the signal sequence and the TCR constant chain. In other embodiments, the FPU lacks an antigen binding domain located between the signal sequence and the TCR constant chain. The FPU may contain additional sequences, such as linkers. As an example, a FPU may contain a MYC2-TAG (EQKLISEEDLGSG) linker between the antigen binding domain and the TCR constant chain. The FPU may also contain a cleavable linker (e.g. P2A, F2A), a Ser-Gly (SGSG) linker, and a furine cleavage site (RAKR).

The term "functional portion" when used in reference to a SIR refers to any part or fragment of the SIR, which part or fragment retains the biological activity of the SIR of which it is a part (the parent SIR). Functional portions encompass, for example, those parts of a SIR that retain the ability to recognize target cells, or detect, treat, or prevent a disease, to a similar extent, the same extent, or to a higher extent, as the parent SIR. In reference to the parent SIR, the functional portion can comprise, for instance, about 10%, 25%, 30%, 50%, 68%, 80%, 90%, 95%, or more, of the parent SIR.

"Genetically modified cells", "redirected cells", "genetically engineered cells" or "modified cells" as used herein refer to cells that have been modified to express synthetic immune receptor (SIR) and may optionally include a chimeric antigen receptor. For example, a genetically modified T-lymphocyte that expresses a SIR is a genetically modified cell.

The term "immune disorder" refers to a disease characterized by dysfunction of immune system. An autoimmune disease is a condition arising from an abnormal immune response to a normal body part. There are at least 80 types of autoimmune diseases.

"Immune effector cell," as that term is used herein, refers to a cell that is involved in an immune response, e.g., in the promotion of an immune effector response. Examples of immune effector cells include T cells, e.g., alpha/beta T cells and gamma/delta T cells, B cells, natural killer (NK) cells, natural killer T (NKT) cells, mast cells, and myeloic-derived phagocytes.

"Immune effector function or immune effector response," as that term is used herein, refers to function or response, e.g., of an immune effector cell, that enhances or promotes an immune attack of a target cell. E.g., an immune effector function or response refers a property of a T or NK cell that promotes killing or the inhibition of growth or proliferation, of a target cell. In the case of a T cell, primary stimulation and co-stimulation are examples of immune effector function or response.

An "intracellular signaling domain," as the term is used herein, refers to an intracellular signaling portion of a molecule. The intracellular signaling domain generates a signal that promotes an immune effector function of the TCR containing cell. Examples of immune effector function include cytolytic activity and helper activity, including the secretion of cytokines. The TCRα/β/γ/δ chains do not have an intracellular signaling domain of their own but transmit a signal by associating with other chains of the TCR signaling complex (e.g., CD3z, CD3e, CD3d and CD3g) that possess a signaling domain.

In another embodiment, the intracellular signaling domain can comprise a primary intracellular signaling domain. Exemplary primary intracellular signaling domains include those derived from the molecules responsible for primary stimulation, or antigen dependent simulation. In another embodiment, the intracellular signaling domain can comprise a costimulatory intracellular domain. Exemplary costimulatory intracellular signaling domains include those derived from molecules responsible for costimulatory signals, or antigen independent stimulation. For example, a primary intracellular signaling domain can comprise a cytoplasmic sequence of CD3z, and a costimulatory intracellular signaling domain can comprise cytoplasmic sequence from co-receptor or costimulatory molecule, such as CD28 or 41BB.

A primary intracellular signaling domain can comprise a signaling motif which is known as an immunoreceptor tyrosine-based activation motif or ITAM. Examples of ITAM containing primary cytoplasmic signaling sequences include, but are not limited to, those derived from CD3 zeta, common FeR gamma (FCER1G), Fe gamma RIIa, FeR beta (Fe Epsilon Rib), CD3 gamma, CD3 delta, CD3 epsilon, CD79a, CD79b, DAPlO, and DAP12.

As used herein, the term "linker" (also "linker domain" or "linker region") refers to an oligo or polypeptide that joins together two or more domains or regions of an SIR disclosed herein. The linker can be anywhere from 1 to 500 amino acids in length. In some embodiments the "linker" is cleavable or non-cleavable. Unless specified otherwise, the term "linker" used herein means a non-cleavable linker. Exemplary non-cleavable linkers that can be used for generation of SIRs are provided in Table 6D. Said non-cleavable linkers may be composed of flexible residues which allow freedom of motion of adjacent protein domains relative to one another. Non-limiting examples of such residues include glycine and serine. In some embodiments, linkers include non-flexible residues. Exemplary embodiments of linkers with non-flexible linkers are EAAAK (SEQ ID NO: 18933), E-coil (SEQ ID NO: 18931), K-coil (SEQ ID NO: 18932), or PG4SP (18929). The SIRs targeting CD19 and containing antigen binding domain derived from FMC63 antibody show more than about 1.5 fold higher binding affinity to the target antigen when constructed with the non-flexible linkers (e.g., EAAAK (SEQ ID NO: 18933), E-coil (SEQ ID NO: 18931), K-coil (SEQ ID NO: 18932), or PG4SP (18929) between the antigen binding domain and the TCR constant chains as compared to a SIR containing no linkers. Therefore, in some embodiments, the non-flexible linkers (e.g., EAAAK (SEQ ID NO: 18933), E-coil (SEQ ID NO: 18931), K-coil (SEQ ID NO: 18932), or PG4SP (18929) represent the preferred linkers for constructing SIRs. In other embodiments, the two linkers joining the antigen binding domain and the TCR constant chains of a double chain SIR share similar length. In other embodiments, the two linkers joining the antigen binding domain and the TCR constant chains of a double chain SIR differ in length by no more than 20 amino acids, typically by no more than 10 amino acids, preferably by no more than 5 amino acids, more preferably by no more than 2 amino acids. In some embodiments, the two linkers joining the antigen binding domain and the TCR constant chains of a double chain SIR have the identical or similar amino acid composition. Exemplary linkers with identical composition are PG4SP (SEQ ID NO: 18922) and PG4SP-v2 (SEQ ID NO: 18923). In some embodiments, the two linkers joining the antigen binding domain and the TCR constant chains of a double chain SIR are PG4SP (DNA SEQ ID NO: 18922; PRT SEQ ID NO: 18929) and PG4SP-v2 (DNA SEQ ID NO: 18923; PRT SEQ ID NO: 18929 or 18930). In some embodiments, the two linkers joining the antigen binding domain and the TCR constant chains of a double chain SIR are EAAAK (SEQ ID NO: 18926; PRT SEQ ID NO:18933 and 18934) and EAAAK-v2 (DNA SEQ ID NO: 18927). In some embodiments, the two linkers joining the antigen binding domain and the TCR constant chains of a double chain SIR are E-coil (DNA SEQ ID NO: 18924) and K-coil (DNA SEQ ID NO: 18925). In some embodiments, the linker may comprise an epitope tag. In some embodiments, the epitope tag is selected from the group of a MYC tag, V5 tag, AcV5 tag, StreptagII, FLAG tag, or HA. In some embodiments, the non-cleavable linker is of a length sufficient to ensure that two adjacent domains do not sterically interfere with one another. In one embodiment of the disclosure, three amino acid residues (Gly-Ser-Gly) are added to the carboxy-terminal of the linkers (e.g., Myc tag or V5 tag) that are located between the antigen binding domain and the TCR constant chain of the SIR. In certain embodiments, the linkers may carry additional sequences, such as restriction enzyme sites. The nucleic sequences of several exemplary linkers are provided in SEQ ID NO: 701 to SEQ ID NO: 725 and amino acid sequences of several exemplary linkers are provide in SEQ ID NO: 2981 to SEQ ID NO: 3003.

The term "flexible polypeptide linker" as used in refers to a peptide linker that consists of amino acids such as glycine and/or serine residues used alone or in combination, to link polypeptide chains together (e.g., variable heavy and variable light chain regions together). In one embodiment, the flexible polypeptide linker is a Gly/Ser linker and comprises the amino acid sequence (Gly-Gly-Gly-Ser)$_n$, where n is a positive integer equal to or greater than 1. For example, n=1, n=2, n=3. n=4, n=5 and n=6, n=7, n=8, n=9 and n=10. In one embodiment, the flexible polypeptide linkers include, but are not limited to, (Gly$_4$Ser)$_4$ or (Gly$_4$Ser)$_3$ (SEQ ID NO:2500). In another embodiment, the linkers include multiple repeats of (Gly$_2$Ser), (GlySer) or (Gly$_3$Ser) (SEQ ID NO: 2501 and 2502). Also included within the scope of the disclosure are linkers described in WO2012/138475, incorporated herein by reference).

Non-limiting examples of cleavable linkers include 2A linkers (for example T2A), picornaviral 2A-like linker, CHYSEL sequences of porcine teschovirus (P2A), Thosea asigna virus (T2A), 2A-like linkers or functional equivalents thereof and combinations thereof. In some embodiments, the linker sequences may comprise a motif that results in cleavage between the 2A glycine and the 2B proline (see, e.g., T2A sequence, SEQ ID NO: 3061, C-terminal Gly-Pro). The nucleic sequences of several exemplary cleavable linkers are provided in SEQ ID NO: 780 to SEQ ID NO: 785 and amino acid sequences of several exemplary linkers are provided in SEQ ID NO: 3060 to SEQ ID NO: 3064. Other cleavable linkers that may be used herein are readily appreciated by those of skill in the art.

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lenti viruses.

The term "lentiviral vector" refers to a vector derived from at least a portion of a lentivirus genome, including especially a self-inactivating lentiviral vector as provided in Milone et al., Mol. Ther. 17(8): 1453-1464 (2009). Other examples of lentivirus vectors that may be used in the clinic, include but are not limited to, e.g., the LENTIVECTOR® gene delivery technology from Oxford BioMedica, the LENTIMAX™ vector system from Lentigen and the like. Nonclinical types of lentiviral vectors are also available and would be known to one skilled in the art. Other examples of lentivirus vectors are pLENTI-EF1α (SEQ ID NO: 870) and pLENTI-EF1α-DWPRE (SEQ ID NO: 871).

"Mammal" as used herein refers to any member of the class Mammalia, including, without limitation, humans and nonhuman primates such as chimpanzees and other apes and monkey species; farm animals such as cattle, sheep, pigs, goats and horses; domestic mammals such as dogs and cats; laboratory animals including rodents such as mice, rats and guinea pigs, and the like. The term does not denote a particular age or sex. Thus, adult and newborn subjects, as well as fetuses, whether male or female, are intended to be included within the scope of this term.

As used herein a "non-naturally occurring TCR antigen binding domain" refers to a binding domain operably linked to a TCR constant region that is chimeric and non-naturally occurring with respect to a TCR present in nature. Stated another way, the non-naturally occurring TCR antigen binding domain is "engineered" using recombinant molecular biology techniques to be operably linked to a TCR and moreover, that the antigen binding domain is obtain or derived from a molecule that is distinct from a TCR found in nature. An antigen binding domain that is distinct from a TCR in nature includes antibody vH and vL fragments, humanized antibody fragments, chimeric antibody fragments, receptor ligands, and the like.

The term "operably linked" refers to functional linkage or association between a first component and a second component such that each component can be functional. For example, operably linked includes the association between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. In the context of two polypeptides that are operably linked a first polypeptide functions in the manner it would independent of any linkage and the second polypeptide functions as it would absent a linkage between the two.

"Percent identity" in the context of two or more nucleic acids or polypeptide sequences, refers to two or more sequences that are the same. Two sequences are "substantially identical" if two sequences have a specified percentage of amino acid residues or nucleotides that are the same (e.g., 60% identity, optionally 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity over a specified region, or, when not specified, over the entire sequence), when compared and aligned for maximum correspondence over a comparison window, or designated region as measured using one of the following sequence comparison algorithms or by manual alignment and visual inspection. Optionally, the identity exists over a region that is at least about 50 nucleotides (or 10 amino acids) in length, or more preferably over a region that is 100 to 500 or 1000 or more nucleotides (or 20, 50, 200 or more amino acids) in length.

For sequence comparison, generally one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. Methods of alignment of sequences for comparison are well known in the art. Optimal alignment of sequences for comparison can be conducted, e.g., by the local homology algorithm of Smith and Waterman, (1970) Adv. Appl. Math. 2:482c, by the homology alignment algorithm of Needleman and Wunsch, (1970) J. Mol. Bioi. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, WI), or by manual alignment and visual inspection (see, e.g., Brent et al., (2003) Current Protocols in Molecular Biology).

Two examples of algorithms that can be used for determining percent sequence identity and sequence similarity are the BLAST and BLAST 2.0 algorithms, which are described in Altschul et al., (1977) Nuc. Acids Res. 25:3389-3402; and Altschul et al., (1990) J. Mol. Bioi. 215:403-410, respectively. Software for performing BLAST analyses is publicly available through the National Center for Biotechnology Information.

The percent identity between two amino acid sequences can also be determined using the algorithm of E. Meyers and W. Miller, (1988) Comput. Appl. Biosci. 4:11-17) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (1970) J. Mol. Bioi. 48:444-453) algorithm which has been incorporated into the GAP program in the GCG software package (available at www.gcg.com), using either a Blossom 62 matrix or a P AM250 matrix, and a gap weight of 16, 14, 12, 10, 8, 6, or 4 and a length weight of 1, 2, 3, 4, 5, or 6.

The term "polynucleotide", "nucleic acid", or "recombinant nucleic acid" refers to polymers of nucleotides such as deoxyribonucleic acid (DNA), and, where appropriate, ribonucleic acid (RNA).

A "protein" or "polypeptide", which terms are used interchangeably herein, comprises one or more chains of chemical building blocks called amino acids that are linked together by chemical bonds called peptide bonds.

The term "retrovirus vector" refers to a vector derived from at least a portion of a retrovirus genome. Examples of retrovirus vector include MSCVneo, MSCV-pac (or MSCV-puro), MSCV-hygro as available from Addgene or Clontech. Other example of a retrovirus vector is MSCV-Bgl2-AvrII-Bam-EcoR1-Xho-BstB1-Mlu-Sal-ClaI.I03 (SEQ ID NO: 872).

The term "Sleeping Beauty Transposon" or "Sleeping Beauty Transposon Vector" refers to a vector derived from at least a portion of a Sleeping Beauty Transposon genome. An example of a Sleeping Beauty Transposon Vector is pSBbi-Pur (SEQ ID NO: 874). Other examples of Sleeping Beauty Transposon Vectors encoding a SIR are provided in SEQ ID NO: 875 and SEQ ID NO: 876.

The term "scFv" refers to a fusion protein comprising at least one antibody fragment comprising a variable region of a light chain and at least one antibody fragment comprising a variable region of a heavy chain, wherein the light and heavy chain variable regions are contiguously linked, e.g., via a synthetic linker, e.g., a short flexible polypeptide linker, and capable of being expressed as a single chain polypeptide, and wherein the scFv retains the specificity of the intact antibody from which it is derived. Unless specified, as used herein an scFv may have the vL and vH variable regions in either order, e.g., with respect to the N-terminal and C-terminal ends of the polypeptide, the scFv may comprise vL-linker-vH or may comprise vH-linker-vL. In this invention, a scFv is also described as vL-Gly-Ser-Linker-vH. For example, FMC63-vL-Gly-Ser-Linker-FMC63-vH refers to a scFv containing the vL and vH fragments of FMC63 monoclonal antibody linked via a linker consisting of Gly and Ser residues. The amino acid sequence of an exemplary Gly-Ser linker is provided in SEQ ID NO: 2500. Alternatively, a scFv is also described as (vL+vH). For example, FMC6-(vL+vH) refers to an scFv containing the vL and vH fragments of FMC63 antibody linked via a linker in which the vL fragment is located at the N-terminal.

The term "signaling domain" refers to the functional region of a protein which transmits information within the cell to regulate cellular activity via defined signaling pathways by generating second messengers or functioning as effectors by responding to such messengers.

The term "Synthetic Immune Receptor" or alternatively a "SIR" refers to a set of polypeptides, typically two in the some embodiments, which when expressed in an effector cell, provides the cell with specificity for a target cell, typically a cancer cell, and with intracellular signal generation. In a typical embodiment, a SIR comprises one or more antigen binding domains (e.g., antibody or antibody fragment, a ligand or a receptor) that bind to antigens as described herein, and are joined to one or more T cell receptor constant chains or regions via an optional linker. In some embodiments, the set of polypeptides are contiguous with each other. In some embodiments, a SIR comprises two or more sets of two or more polypeptides. The polypeptides of each set of SIR are contiguous with each other (functional polypeptide unit 1) but are not contiguous with the polypeptides of the other set (functional polypeptide unit 2). In some aspects, the T cell receptor constant chains (or regions) of the SIR is chosen from the constant chain of human T cell receptor-alpha (TCR-alpha or TCRα or TCRa or hTCR-alpha or hTCRα or hTCRa or Cα), human T cell receptor-beta1 (TCR-beta1 or TCRβ1 or TCRb1 or hTCR-beta1 or hTCRβ1 or hTCRb1 or Cβ1), human T cell receptor-beta 2 (TCR-beta2 or TCRβ2 or TCRb2 or hTCR-beta2 or hTCRβ2 or hTCRb2 or Cβ2 also designated TCR-beta, TCRβ or TCRb or Cβ), human Pre-T cell receptor alpha ((preTCR-alpha or preTCRα or preTCRa or preCα), human T cell receptor-gamma (TCR-gamma or TCRγ or TCRg or hTCR-gamma or hTCRγ or hTCRg or hTCRγ1 or hTCR-gamma1, or Cγ), or human T cell receptor-delta (TCR-delta or TCRd or TCRδ or hTCR-delta or hTCRd or hTCRδ or Cδ). In some embodiments, the TCR constant chains of SIR are encoded by their wild-type nucleotide sequences while in other aspects the TCR constant chains of SIR are encoded by the nucleotide sequences that are not wild-type. In some embodiments, the TCR constant chains of SIR are encoded by their codon optimized sequences. In some embodiments, the TCR constant chains of SIR encode for the wild-type polypeptide sequences while in other embodiments the TCR constant chains of SIR encoded for polypeptides that carry one or more mutations. In some embodiments, the TCR constant chains of SIR are encoded by their codon optimized sequences that carry one or more mutations. A SIR that comprises an antigen binding domain (e.g., a scFv, or vHH) that targets a specific tumor maker "X", such as those described herein, is also referred to as X-SIR or XSIR. For example, a SIR that comprises an antigen binding domain that targets CD19 is referred to as CD19-SIR or CD19SIR. The TCR constant chain/domain of a SIR can be derived from the same species in which the SIR will ultimately be used. For example, for use in humans, it may be beneficial for the TCR constant chain of the SIR to be derived from or comprised of human TCR constant chains. However, in some instances, it is beneficial for the TCR constant chain to be derived from the same species in which the SIR will ultimately be used in, but modified to carry amino acid substitutions that enhance the expression of the TCR constant chains. For example, for use in humans, it may be beneficial for the TCR constant chain of the SIR to be derived from or comprised of human TCR constant chains but in which certain amino acids are replaced by the corresponding amino acids from the murine TCR constant chains. Such murinized TCR constant chains provide increased expression of the SIR. The amino acid sequences of exemplary murinized TCR constant chains are provided in SEQ ID NO: 3017, SEQ ID NO: 3033 to 3039 (see also, Tables 1-3). The SIR or functional portion thereof, can include additional amino acids at the amino or carboxy terminus, or at both termini, which additional amino acids are not found in the amino acid sequence of the TCR or antigen binding domain which make up the SIR. Desirably, the additional amino acids do not interfere with the biological function of the SIR or functional portion, e.g., recognize target cells, detect cancer, treat or prevent cancer, etc. More desirably, the additional amino acids enhance the biological activity, as compared to the biological activity of the parent SIR.

The term "stimulation," refers to a primary response induced by binding of a stimulatory molecule (e.g., a TCR/CD3 complex or SIR) with its cognate ligand (or target antigen in the case of a SIR) thereby mediating a signal transduction event, such as, but not limited to, signal transduction via the TCR/CD3. Stimulation can mediate altered expression of certain molecules.

The term "stimulatory molecule," refers to a molecule expressed by an immune cell (e.g., T cell, NK cell, B cell) that provides the cytoplasmic signaling sequence(s) that regulate activation of the immune cell in a stimulatory way for at least some aspect of the immune cell signaling pathway. In one aspect, the signal is a primary signal that is initiated by, for instance, binding of a TCR/CD3 complex with an MHC molecule loaded with peptide, and which leads to mediation of a T cell response, including, but not limited to, proliferation, activation, differentiation, and the like. A primary cytoplasmic signaling sequence (also referred to as a "primary signaling domain") that acts in a stimulatory manner may contain a signaling motif which is known as immunoreceptor tyrosine-based activation motif or ITAM. Examples of an ITAM containing cytoplasmic signaling sequence includes, but is not limited to, those derived from CD3 zeta, common FeR gamma (FCERIG), Fe gamma RIIa, FeR beta (Fe Epsilon Rib), CD3 gamma, CD3 delta, CD3 epsilon, CD79a, CD79b, DAPIO, and DAP12.

The term "subject" is intended to include living organisms in which an immune response can be elicited (e.g., any domesticated mammals or a human).

The terms "T-cell" and "T-lymphocyte" are interchangeable and used synonymously herein. Examples include but are not limited to naïve T cells ("lymphocyte progenitors"), central memory T cells, effector memory T cells, stem memory T cells ($T_{scm}$), iPSC-derived T cells, synthetic T cells or combinations thereof.

The term "therapeutic effect" refers to a biological effect which can be manifested by various means, including but not limited to, e.g., decrease in tumor volume, a decrease in the number of cancer cells, a decrease in the number of metastases, an increase in life expectancy, decrease in cancer cell proliferation, decrease in cancer cell survival, decrease in the titer of the infectious agent, a decrease in colony counts of the infectious agent, amelioration of various physiological symptoms associated with a disease condition. A "therapeutic effect" can also be manifested by the ability of the peptides, polynucleotides, cells and antibodies in prevention of the occurrence of disease in the first place or in the prevention of relapse of the disease.

The term "transfer vector" refers to a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "transfer vector" includes an autonomously replicating plasmid or a virus. The term should also be construed to further include non-plasmid and non-viral compounds which facilitate transfer of nucleic acid into cells, such as, for example, a poly lysine compound, liposome, and the like. Examples of viral transfer vectors include, but are not limited to, adenoviral vectors, adena-associated virus vectors, retroviral vectors, lentiviral vectors, and the like.

"Treatment" and "treating," as used herein refer to both therapeutic treatment and prophylactic or preventative measures, wherein the object is to prevent or slow down (lessen) the targeted pathologic condition, prevent the pathologic condition, pursue or obtain beneficial results, or lower the chances of the individual developing the condition even if the treatment is ultimately unsuccessful. Those in need of treatment include those already with the condition as well as those prone to have the condition or those in whom the condition is to be prevented.

"Tumor," as used herein refers to all neoplastic cell growth and proliferation, whether malignant or benign, and all pre-cancerous and cancerous cells and tissues.

The term "zeta" or alternatively "zeta chain", "CD3-zeta" or "TCR-zeta" is defined as the protein provided as GenBan Ace. No. BAG36664.1, or the equivalent residues from a non-human species, e.g., mouse, rodent, monkey, ape and the like, and a "zeta stimulatory domain" or alternatively a "CD3-zeta stimulatory domain" or a "TCR-zeta stimulatory domain" is defined as the amino acid residues from the cytoplasmic domain of the zeta chain, or functional derivatives thereof, that are sufficient to functionally transmit an initial signal necessary for T cell activation. In one aspect the cytoplasmic domain of zeta comprises residues 52 through 164 of GenBank Ace. No. BAG36664.1 or the equivalent residues from a non-human species, e.g., mouse, rodent, monkey, ape and the like, that are functional orthologs thereof. In one aspect, the "zeta stimulatory domain" or a "CD3-zeta stimulatory domain" is the sequence provided as SEQ ID NO: 18. In one aspect, the "zeta stimulatory domain" or a "CD3-zeta stimulatory domain" is the sequence provided as SEQ ID N0:20.

As described above and elsewhere herein, each chain of the SIRs of the disclosure have a general structure: Signal Peptide-(binding domain)-(optional linker)-(T cell receptor constant region)-(optional accessory molecule). The T cell receptor constant region of a SIR may comprise of a fusion between a T cell receptor constant chain and a CD3 signaling chain with an optional co-stimulatory domain. Exemplary TCRβ constant chain and CD3z fusion proteins are provided in SEQ ID NO: 12401-12407. Exemplary TCRβ constant chain and CD3z fusion proteins with an additional costimulatory domain are provided in SEQ ID NO: 12408-12409. Exemplary TCRα constant chain and CD3z fusion proteins are provided in SEQ ID NO: 12422-12426. Exemplary TCRα constant chain and CD3z fusion proteins with an additional costimulatory domain are provided in SEQ ID NO: 12427-12428. The following describe each "domain" or "section" of the SIRs of the disclosure. One of skill in the art will recognize that various TCRs can be shuffled and combined with different binding domains etc.

The disclosure provides polynucleotide sequences encoding SIRs of the disclosure, SIR polypeptides, expression constructs, recombinantly engineered cells comprising SIRs or constructs of the disclosure, as well as method of making and using such polypeptides, polynucleotides and cells.

The disclosure provides isolated nucleic acid molecule encoding a Synthetic Immune receptor (SIR), wherein the SIR comprises one or more antigen binding domains (e.g., antibody or antibody fragment, an autoantigen, a ligand or a receptor) that bind to antigens as described herein, and are jointed to one or more T cell receptor constant chains.

In some embodiments, a SIR may comprise or consist of a single antigen binding domain joined to a single T cell receptor constant chain. In some embodiments, a SIR may comprise or consist of more than one antigen binding fragments (e.g., a vL and a vH fragment or two vHH fragments) that are joined via a linker and are in turn joined to a single T cell receptor constant chain (e.g., SEQ ID NO: 1169, SEQ ID NO: 1182, SEQ ID NO: 10497-10508; 10524-10538). In another embodiments, a SIR comprises or consists of two antigen binding domains that are each joined in frame to a separate T cell receptor constant chain (e.g., SEQ ID NO: 1200). For example, antigen binding domain 1 is joined to the constant chain of TCRα (Cα) to constitute functional unit 1 and antigen binding domain 2 is joined to the constant chain of TCRβ (Cβ) to constitute functional unit 2. The two functional units of such SIR are coexpressed in the same cell to become functionally active. In some embodiments, the two functional units of the SIR are coexpressed using a single vector, while in other embodiments the two functional units are coexpressed in the same cells using different vectors. In some embodiments, the two functional units of the SIR are coexpressed by transfection of a single mRNA sequence that encodes for both functional units, while in other embodiments the two functional units are coexpressed by transfection of two different mRNA sequences, each encoding for one functional unit.

In yet another embodiments, a SIR comprises or consists of an antigen binding domains that is joined to one T cell receptor constant chain (functional unit 1) but is coexpressed with a second T cell receptor constant chain (e.g., SEQ ID NO:1620). The purpose of the second T cell receptor constant chain in such SIRs is to facilitate the cell surface expression of the functional unit 1 (e.g., antigen binding domain 1 joined to a T cell receptor constant chain). As such, the second T cell receptor constant chain may be expressed by itself or expressed as a fusion protein carrying an epitope tag (e.g. MYC, V5, AcV5, G4S×2, StrepTagII etc) or expressed as a fusion protein carrying any irrelevant protein fragment (e.g. vL or vH fragment) that does not interfere with the assembly and function of the functional unit 1. As an example, a SIR may comprise or consist of antigen binding domain 1 joined to Cα and an empty (i.e. lacking an antigen binding domain) Cβ (e.g., SEQ ID NO: 1620). The two functional units of such SIR are coexpressed in the same cell to become functionally active. In some embodiments, the two functional units of the SIR are coexpressed using a single vector, while in other embodiments the two functional units are coexpressed in the same cells using different vectors. In some embodiments, the two functional units of the SIR are coexpressed by transfection of a single mRNA sequence that encodes for both functional units, while in other embodiments the two functional units are coexpressed by transfection of two different mRNA sequences, each encoding for one functional unit.

The SIRs described herein may be encoded by a single polynucleotide chain and translated into a single polypeptide chain, which is subsequently cleaved into different proteins. The nucleic acid molecule encoding a SIR can comprises one or more leader sequences (also known as a signal peptide). In one embodiment, each functional unit (e.g., an antigen binding domain joined to a T cell receptor constant chain plus Furine-SGSG-cleavable linker or a T cell receptor constant chain plus Furine-SGSG-cleavable linker) of a SIR can be preceded by a leader sequence which directs the SIR to the cell surface as a type I transmembrane protein. In one embodiment, the antigen-binding domain of SIR is extracellular-facing. In some embodiments, the leader sequence comprises the nucleic acid sequence of any of SEQ ID NO: 1 to 9 and amino acid sequences of SEQ ID NO: 2300 to SEQ ID NO: 2302. In some embodiments, short nucleic acid sequences (3-9 nucleic acids) comprising restriction enzyme sites are located between the different subunits of a SIR, e.g., between a signal sequence and the antigen binding domain of the SIR or between the antigen binding and the TCR chain.

Synthetic Immune Receptors (SIRs) can be generated with different TCR constant chains. The TCR constant chains may be encoded by their wild-type sequences, non-wild-type sequences or codon optimized sequences. In addition, the TCR constant chains may carry specific mutations (e.g. TCRβ constant chain with one or more mutation set forth in Table 2 or 3 and TCRα constant chain with one or more mutations in Table 1) to enhance their cell surface expression and/or pairing with each other and to reduce pairing with endogenous TCR chains. The mutations in the TCR domain of a SIR modify the binding affinity and/or expression of the SIR to a target or cell, respectively. For example, the disclosure contemplates a diverse population of SIRs against a particular antigen target that can be designed and screened based upon the nucleic acid sequence codon optimization and/or the mutation in the TCR chain to promote pairing or expression and/or the use of a linker between the binding domain and the TCR domain. In some embodiments, an immune effector cell expressing a SIR from the pool shows more than 2 fold, more than 5-fold, more than 10-fold, and even more than 100-fold difference in one or more of the characteristics selected from the group of antigen binding affinity, cell surface expression, cell signaling, NFAT reporter activity, cytotoxicity, cytokine secretion, proliferation, in vivo persistence, expression of exhaustion markers, and in vivo activity as compared to a comparable immune effector cell expressing another SIR from the pool containing the same binding domain, (e.g., a binding domain derived from the same scFv as is present in the test SIR) when assayed under similar conditions. The disclosure contemplates a library of X-SIR molecules wherein X is the antigen binding domain target such that library or "pool" provides SIRs with varied binding affinity, expression levels and functional characteristics (e.g., cytotoxicity, cytokine production and long-term persistence). In some embodiments, the a SIR in the pool have more than 2 fold, preferably more than 5-fold, even more preferably more than 10-fold, and even more preferably more than 100-fold difference in one or more of the characteristics selected from the group of antigen binding affinity, cell surface expression, cytotoxicity, cytokine secretion, T cell proliferation, T cell persistence, T cell exhaustion, and in vivo activity when expressed in an immune effector cell as compared to another SIR in the pool containing the same binding domain, (e.g., a binding domain derived from the same scFv as is present in the test SIR) when assayed under similar conditions. The different SIRs in the pool may be tagged with different DNA barcodes to allow their identification by next-generation sequencing or other techniques known in the art. Exemplary barcodes are presented by SEQ ID NO: 864 to 869. The barcodes may be inserted in the vector encoding the SIR at a convenient location so that they do not interfere with the expression of the SIR. In an exemplary embodiment, the barcodes are inserted immediately downstream of the stop codon of the SIR. One of skill in the art can screen such pools to identify X-SIRs with a desired binding affinity, expression level or functional characteristics using any one or more of the assay described herein. Different SIRs or different pools of SIRs may be suitable for different diseases and disease conditions and may be combined to generate a diverse and polyclonal immune response. Thus, T cell expressing a SIR with higher affinity for the target may be more effective in killing a tumor cell in the short term but may exhaust quickly and/or have short term persistence in vivo. Such T cells expressing a high affinity SIR may be combined with T cells expressing a low affinity SIR that may not be as effective in killing a tumor cell in the short term but may not exhaust quickly and/or persist longer in vivo. The SIRs of the disclosure, including the different pools of SIRs, may be also combined with other genetically engineered T cells, such as CAR-T cells, to generate a diverse immune response. Accordingly, the disclosure provides a library of X-SIRs.

As described above and herein a SIR comprises one or more antigen binding domains operably linked to one or more T cell receptor (TCR) constant chain regions. A SIR of the disclosure can comprise a human beta 1 chain constant region (Cβ1) or a human beta 2 chain constant region (Cβ2). In one embodiment, the human constant beta region (1 or 2) of SIR comprises a basic amino acid at position 18. This basic amino acid is selected from the group consisting of arginine (R) and lysine (K). The term "position 18" refers to the 18th amino acid residue in the sequence of SEQ ID NO: 3025 (for Cβ2) or SEQ ID NO: 3024 (for Cβ1). Besides this mutation at position 18, the Cβ1 or the Cβ2 of the SIR may comprise further mutations so long as the biological function of the SIR remains intact. A biological activity is intact if it still performs similarly although not identically (e.g., better or worse). The term "function of the SIR" is meant to refer to the ability of a SIR to specifically bind to a given antigen, e.g., with a particular affinity, and/or to respond to it by activating cellular signaling that results in activation of T cell functions, such as activation, proliferation, cytokine secretion and/or cytotoxicity.

In one embodiment, the SIR comprises at least one additional mutation in the Cβ1 or Cβ2 chains in addition to having a basic amino acid at position 18. This mutation is selected from the group consisting of an alanine (A) at position 22, an isoleucine (I) at position 133, an alanine (A) at position 136, and a histidine (H) at position 139, wherein the positions mentioned are those in the sequence of SEQ ID NO:3025 (for Cβ2) or SEQ ID NO:3024 (for Cβ1). In another embodiment, the SIR comprises a basic amino acid at positon 18 of C1 or Cβ2 chains and two or more additional mutations from the group consisting of an alanine (A) at position 22, an isoleucine (I) at position 133, an alanine (A) at position 136, and a histidine (H) at position 139, wherein the positions mentioned are those in the sequence of SEQ ID NO: 3025 (for Cβ2) or SEQ ID NO: 3024 (for Cβ1).

This disclosure demonstrates that SIRs containing additional cysteines in the constant region of the α and β chains can promote preferential pairing with each other, increase total surface expression of the introduced SIR, improve binding affinity for the target antigen and improve functionality. For example, a SIR with a Thr 48 Cys (T48C) mutation in Cα and a Ser-57-Cys (S57C) mutation in Cβ1 or Cβ2 chain has an additional disulfide bond between the two chains which reduces mispairing with the endogenous TCR chains and enhances functionality. Other disulfide bond locations (or combination thereof) are as follows: Cα-T48C with Cβ1 or Cβ2-S57C, Cα-S15C and Cβ1 or Cβ2-E15C, Cα-T45C and Cβ1 or Cβ2-D59C, Cα-T45C and Cβ1 or Cβ2-S77C, Cα-Y10C and Cβ1 or Cβ2-S17C.

Another approach to overcome the problem of undesired pairing of introduced TCRα- and TCRβ-chains with the endogenous TCR chains includes the use of "knob-into-hole" or "hole-into-knob" configuration and the electrostatic environment. The disclosure demonstrates that a SIR with a Ser 61 Arg (S61R) mutation in Cα and an Arg 79 Gly (R79G) mutation in Cβ1 or Cβ2 chain also results in reduced mispairing with the endogenous TCR chains and enhanced functionality. Other approaches to enhance the expression of introduced TCR chains, such as removal of N-glycosylation sites can also be used in the method of the disclosure to generate SIR with increased surface expression and functionality.

Another approach to overcome the problem of undesired pairing of introduced TCRα- and TCRβ-chains of the SIR with the endogenous TCR chains includes the use of genetic targeting to knock-out the expression of the endogenous TCRα or/and TCRβ chains. The knock-out of the endogenous TCRα or/and TCRβ chains can be achieved using a number of techniques known in the art, such as the use of CRISP/Cas9 and Zn finger nucleases. Such TCRα/β knock-out cells can be used to introduce the SIRs of the disclosure. In an alternate embodiment, the same approach can be used to enhance the expression and chain pairing of the cTCRs, including the cTCRs of the disclosure listed in Table 7A. When expressed in T cells in which the expression of endogenous TCR chains is reduced or eliminated, the CTCRs acquire some of the functional properties of SIRs. In an alternate embodiment of the disclosure, SIRs or cTCRs can be introduced in the T cells or iPSC or stem cell first followed by knock-out of TCRα and TCRβ chains. Essentially a similar approach can be used to reduce or eliminate the expression of endogenous TCRγ or/and TCRδ chains in case it is desired to express a SIR or a cTCR in TCRγδ cells.

Tables 1-3 provide non-limiting examples of suitable substitutions in Cα, Cβ1 and Cβ2 polypeptide chains. Further substitutions are also possible. For example, an equivalent amino acids can be used in the same "mutation" position (i.e., a conservative substitution).

Additional mutations in the constant regions of TCRα, TCRβ1, and TCRβ2 that lead to increased expression of the introduced SIR chains and decreased mispairing with the endogenous TCR chains can be incorporated in the design of the SIR of the disclosure. Furthermore, it is known in the literature that murine TCR are better expressed as compared to human TCR. The disclosure demonstrates that SIRs containing murinized human TCRα and β chains (i.e., in which certain amino acid residues of human TCRα and β constant regions are replaced with the corresponding amino acids of mouse TCRα and β chains) are better expressed as compared with SIRs containing wild-type amino acid sequences of human TCRα and β constant chains. Additional mutations of human TCRα and TCRβ chains can be similarly generated based on the sequence of mouse TCRα and TCRβ chains. SIR containing such murinized TCRα and TCRβ chains can be easily tested in the assays described herein (e.g., binding to target antigens using NLuc binding assay, cytokine secretion, cell killing, Jurkat NFAT-GFP assay, etc.) to identify variants that result in increased expression and/or functional activity of the SIR.

The nucleic acids encoding the SIRs of the disclosure encode one or more T cell receptor constant chains or regions. The nucleic acid sequences of exemplary T cell receptor constant chains or regions that can be used to make a SIR are provided in SEQ ID NO: 730 to 775, 10427-10452, and 10464-10471. The corresponding amino acid sequences are provided in SEQ ID NO: 3010 to 3055, 12384-12409, and 12421-12428 (Table 4). In some embodiments, the nucleic acid sequence encoding the T cell receptor constant chains of the encoded SIR molecule comprises the wild-type sequences of constant chains of human T cell receptor-alpha (TCR-alpha or TCRα or TCRa or Cα; SEQ ID NO:730 and 731), human T cell receptor-beta1 (TCR-beta1 or TCRβ1 or TCRb1 or Cβ1; SEQ ID NO: 744), human T cell receptor-beta 2 (TCR-beta2 or TCRβ2 or TCRb2 or Cβ2 also designated TCR-beta, TCRβ or TCRb or Cβ; SEQ ID NO: 745 and 746), human Pre-T cell receptor alpha (preTCR-alpha or preTCRα or preTCRa or preCα), human T cell receptor-gamma (TCR-gamma or TCRγ or TCRg or Cγ; SEQ ID NO:769), or human T cell receptor-delta (TCR-delta or TCRd or TCRδ or Cδ).

TABLE 4

| SEQ ID-DNA | SEQ ID PRT | NAME | SEQ ID DNA | SEQ ID PRT | NAME |
|---|---|---|---|---|---|
| 730 | 3010 | hTCR-alpha-constant-region_X02883.1 | 752 | 3032 | hTCRb1-opt4 |
| 731 | 3011 | hTCRa-WT | 753 | 3033 | hTCRb-KAIAH |
| 732 | 3012 | hTCRa-CSDVP | 754 | 3034 | hTCRb-K18A22 |
| 733 | 3013 | hTCRa-opt2 | 755 | 3035 | hTCRb-K18I133 |
| 734 | 3014 | hTCRa-opt3 | 756 | 3036 | hTCRb-K18A136 |
| 735 | 3015 | hTCRa-T48C-opt | 757 | 3037 | hTCRb-K18H139 |
| 736 | 3016 | hTCRa-T48C-opt1 | 758 | 3038 | hTCRb-R18A22 |
| 737 | 3017 | hTCRa-SDVP | 759 | 3039 | hTCRb-R18 |
| 738 | 3018 | hTCRa-S61R | 760 | 3040 | hTCRb-KAIAHG |
| 739 | 3019 | hTCRa-SDVPR | 761 | 3041 | hTCRb-KAG |
| 740 | 3020 | hTCRa-SD | 762 | 3042 | hTCRb-R79G |
| 741 | 3021 | hTCRaECD-CD3zECDTMCP-opt2 | 763 | 3043 | mTCRb-opt |
| 742 | 3022 | mTCRa-opt | 764 | 3044 | cTCRb-opt |
| 743 | 3023 | cTCRa-opt | 765 | 3045 | hTCRbECD-CD3zECDTMCP-opt |
| 744 | 3024 | hTCR-b1-constant-region_X00437.1 | 766 | 3046 | preTCRa-U38996.1 |
| 745 | 3025 | hTCR-b2-constant-region_L34740 | 767 | 3047 | preTCRa |
| 746 | 3026 | hTCRb-WT | 768 | 3048 | preTCRa-del48 |
| 747 | 3027 | hTCRb-S57C-opt (also hTCRb-C57C-opt1) | 769 | 3049 | hTCR-gamma_M27331.1 |
| 748 | 3028 | hTCRb-KACIAH | 770 | 3050 | hTCR-Gamma-Opt |
| 749 | 3029 | hTCRb-opt2 | 771 | 3051 | hTCR-Delta |
| 750 | 3030 | hTCRb-opt2-deltaE | 772 | 3052 | hTCR-Delta-Opt |
| 751 | 3031 | hTCRb-opt3 | 773 | 3053 | hTCRa-opt2-Del |
| 10427 | 12384 | TCRa-Y10C | 774 | 3054 | hTCRb-RC |
| 10428 | 12385 | TCRa-S15C | 775 | 3055 | hTCRb-RAC |
| 10429 | 12386 | TCRa-T45C | 10444 | 12401 | hTCRbECD-Bam-CD3zECDTMCP-opt |
| 10430 | 12387 | TCRb-E15C | 10445 | 12402 | hTCRb-KAC-ECD-Bam-CD3zECDTMCP-opt |
| 10431 | 12388 | TCRb-S17C | 10464 | 12421 | hTCRaECD-Kpn-CD3zECDTMCP-opt2 |
| 10432 | 12389 | TCRb-D59C | 10465 | 12422 | hTCRa-CSDVP-ECD-Kpn-CD3zECDTMCP-opt2 |
| 10433 | 12390 | TCRb-S77C | 18228 | 18236 | hTCRb-E15C-KAIAH |
| 18226 | 18234 | hTCRa-S15C-SDVP | 18229 | 18237 | hTCRb-E15C-KACIAH |
| 18227 | 18235 | hTCRa-S15C-CSDVP | 10453 | 12410 | TCRbECD-Bam-CD3zECDTM-BB-CD3e-CP-opt |
| 10446 | 12403 | hTCRb-S57C-ECD-Bam-CD3zECDTMCP-opt | 10466 | 12423 | hTCRa-T48C-ECD-Kpn-CD3zECDTMCP-opt2 |
| 10447 | 12404 | hTCRb-E15C-ECD-Bam-CD3zECDTMCP-opt | 10467 | 12424 | hTCRa-Y10C-ECD-Kpn-CD3zECDTMCP-opt2 |

TABLE 4-continued

| SEQ ID-DNA | SEQ ID PRT | NAME | SEQ ID DNA | SEQ ID PRT | NAME |
|---|---|---|---|---|---|
| 10448 | 12405 | hTCRb-S17C-ECD-Bam-CD3zECDTMCP-opt | 10468 | 12425 | hTCRa-S15C-ECD-Kpn-CD3zECDTMCP-opt2 |
| 10449 | 12406 | hTCRb-D59C-ECD-Bam-CD3zECDTMCP-opt | 10469 | 12426 | hTCRa-T45C-ECD-Kpn-CD3zECDTMCP-opt2 |
| 10450 | 12407 | hTCRb-S77C-ECD-Bam-CD3zECDTMCP-opt | 10470 | 12427 | hTCRaECD-Kpn-CD3zECDTM-28z-opt2 |
| 10451 | 12408 | hTCRbECD-Bam-CD3zECDTM-28z-opt | 10471 | 12428 | hTCRaECD-Kpn-CD3zECDTM-BBz-opt2 |
| 10452 | 12409 | hTCRbECD-Bam-CD3zECDTM-BBz-opt | 10472 | 12429 | hTCRaECD-Kpn-CD3zECDTM-BB-CD3e-CP-opt2 |

In some embodiments, the nucleic acid sequence encoding the T cell receptor constant chains of the encoded SIR molecule comprises a non-wild-type nucleic acid sequences of human T cell receptor-alpha (TCR-alpha or TCRα or TCRa or Cα), human T cell receptor-beta1 (TCR-beta1 or TCRβ1 or TCRb1 or Cβ1), human T cell receptor-beta 2 (TCR-beta2 or TCRβ2 or TCRb2 or Cβ2 also designated TCR-beta, TCRβ or TCRb or Cβ), human Pre-T cell receptor alpha ((preTCR-alpha or preTCRα or preTCRa or preCα), human T cell receptor-gamma (TCR-gamma or TCRγ or TCRg or Cγ), or human T cell receptor-delta (TCR-delta or TCRd or TCRδ or Cδ). For example, a non-wild-type sequence can be a codon optimized sequence and/or a sequence comprising one or more mutations that result in a mutation in the encoded polypeptide.

In some embodiments, the nucleic acid sequence encoding a T cell receptor constant chain of the encoded SIR molecule comprises the codon optimized sequences of human T cell receptor-alpha (TCR-alpha or TCRα or TCRa or Cα), human T cell receptor-beta1 (TCR-beta1 or TCRβ1 or TCRb1 or Cβ1), human T cell receptor-beta 2 (TCR-beta2 or TCRβ2 or TCRb2 or Cβ2 also designated TCR-beta, TCRβ or TCRb or Cβ), human Pre-T cell receptor alpha (preTCR-alpha or preTCRα or preTCRa or preCα), human T cell receptor-gamma (TCR-gamma or TCRγ or TCRg or Cγ), or human T cell receptor-delta (TCR-delta or TCRd or TCRδ or Cδ). An exemplary codon optimized human TCRβ1 constant region nucleic acid sequences is provided in SEQ ID NO: 752. Exemplary codon optimized human TCRβ2 constant region nucleic acid sequences are provided in SEQ ID NO: 749 and 750.

In some embodiments, the nucleic acid sequence encoding a T cell receptor constant chain of the encoded SIR molecule comprises the constant chains of human T cell receptor-alpha (TCR-alpha or TCRα or TCRa or Cα), human T cell receptor-beta1 (TCR-beta1 or TCRβ1 or TCRb1 or Cβ1), human T cell receptor-beta 2 (TCR-beta2 or TCRβ2 or TCRb2 or Cβ2 or Cβ2; also designated TCR-beta, TCRβ or TCRb or Cβ), human Pre-T cell receptor alpha ((preTCR-alpha or preTCRα or preTCRa or preCα), human T cell receptor-gamma (TCR-gamma or TCRγ or TCRg or Cγ), or human T cell receptor-delta (TCR-delta or TCRd or TCRδ or Cδ) that carry specific mutations (point mutations or deletions or both) that enhance the expression and pairing of the chains of SIR and reduce their pairing with the endogenous T cell receptor chains.

In some embodiments, the nucleic acid sequence encoding a T cell receptor constant chain of the encoded SIR molecule comprise constant chains of human T cell receptor-alpha (TCR-alpha or TCRα or TCRa or Cα), human T cell receptor-beta1 (TCR-beta1 or TCRβ1 or TCRb1 or Cβ1), human T cell receptor-beta2 (TCR-beta2 or TCRβ2 or TCRb2 or Cβ2 or Cβ2; also designated TCR-beta, TCRβ or TCRb or Cβ), human Pre-T cell receptor alpha ((preTCR-alpha or preTCRα or preTCRa or preCα), human T cell receptor-gamma (TCR-gamma or TCRγ or TCRg or Cγ), or human T cell receptor-delta (TCR-delta or TCRd or TCRδ or Cδ) that are codon optimized and carry specific mutations (point mutations or deletions or both) that enhance the expression and pairing of the chains of SIR and reduce their pairing with the endogenous T cell receptor chains.

In some embodiments, the nucleic acid sequence encoding the T cell receptor constant chains of the encoded SIR molecule comprises the wild-type, non-wild-type or codon optimized constant chains of canine T cell receptor-alpha (TCR-alpha or TCRα or TCRa or Cα), canine T cell receptor-beta (TCR-beta or TCRβ or TCRb or Cβ), canine Pre-T cell receptor alpha ((preTCR-alpha or preTCRα or preTCRa or preCα), canine T cell receptor-gamma (TCR-gamma or TCRγ or TCRg or Cγ), or canine T cell receptor-delta (TCR-delta or TCRd or TCRδ or Cδ).

In some embodiments, the nucleic acid sequence encoding the T cell receptor constant chains of the encoded SIR molecule comprises the constant chains of canine T cell receptor-alpha (TCR-alpha or TCRα or TCRa or Cα), canine T cell receptor-beta (TCR-beta or TCRβ or TCRb or Cβ), canine Pre-T cell receptor alpha ((preTCR-alpha or preTCRα or preTCRa or preCα), canine T cell receptor-gamma (TCR-gamma or TCRγ or TCRg or Cγ), or canine T cell receptor-delta (TCR-delta or TCRd or TCRδ or Cδ) that are codon optimized and carry specific mutations (point mutations or deletions or both) that enhance the expression and pairing of the chains of SIR and reduce their pairing with the endogenous T cell receptor chains.

In some embodiments, the nucleic acid sequence encoding the T cell receptor constant chains of the encoded SIR molecule comprises the wild-type, non-wild-type or codon optimized constant chains of murine T cell receptor-alpha (TCR-alpha or TCRα or TCRa or Cα), murine T cell receptor-beta (TCR-beta or TCRβ or TCRb or Cβ), murine Pre-T cell receptor alpha ((preTCR-alpha or preTCRα or preTCRa or preCα), murine T cell receptor-gamma (TCR-gamma or TCRγ or TCRg or Cγ), or murine T cell receptor-delta (TCR-delta or TCRd or TCRδ or Cδ) that may or may not carry specific mutations (point mutations or deletions or both) that enhance the expression and pairing of the chains of SIR and reduce their pairing with the endogenous T cell receptor chains.

In certain embodiments, the nucleic acid sequence of the SIR molecule comprises a nucleic acid sequence of human T cell receptor alpha (TCR-alpha or TCRα or TCRa or hTCRa or hTCRα or Cα) constant chain as shown in SEQ ID NO:730, SEQ ID NO:731 or SEQ ID NO:733. In certain embodiments, the nucleic acid sequence of the SIR molecule encodes for an amino acid sequence of a constant chain of human T cell receptor alpha having at least one, five or nine modifications but not more than 20, of an amino acid sequence of SEQ ID NO: 3010 or SEQ ID NO: 3011, or a sequence with 80-99% identity to an amino acid sequence of SEQ ID NO: 3010 or SEQ ID NO: 3011. In certain embodiments, the nucleic acid sequence of the SIR molecule encodes for a constant chain of human TCRa comprising the sequence of SEQ ID NO: 3010 or SEQ ID NO: 3011.

In certain embodiments, the nucleic acid sequence of the SIR molecule comprises the nucleic acid sequence of human T cell receptor alpha constant region (chain) encoding an amino acid sequence of SEQ ID NO:3010 but carrying one or more mutations including a Serine (S) at position 91, a (D) at position 92, a valine (V) at position 93, a proline (P) at position 94, a cysteine (C) at position 48 and an Arginine (R) at position 61 (e.g., SEQ ID NO:732, 735, 736, 737, 738, 739, or 740).

In certain embodiments, the nucleic acid sequence of the SIR molecule comprises the nucleic acid sequence of human T cell receptor alpha constant region (chain) encoding an amino acid sequence of SEQ ID NO: 3010 but in which one or more amino acids are replaced by the corresponding amino acids of mouse TCRα constant chain (SEQ ID NO:3022).

In certain embodiments, the nucleic acid sequence of the SIR molecule comprises the nucleic acid sequence of human T cell receptor alpha (TCR-alpha or TCRα or TCRa or hTCRa or hTCRα or Cα) constant chain as shown in SEQ ID NO: 732. In certain embodiments, the nucleic acid sequence of the SIR molecule encodes for constant chain of human TCRa carrying amino acid substitutions (CSDVP) that enhance the expression and chain-pairing of the encoded polypeptide with the complementary TCRb constant chain of the SIR and reduce chain-pairing with the endogenous TCRβ chain. In certain embodiments, the nucleic acid sequence of the SIR comprises sequence that encodes for amino acid sequence of constant chain of human T cell receptor alpha having at least one, five or ten modifications but not more than 20 modifications of an amino acid sequence of SEQ ID NO: 3012, or a sequence with 80-99% identity to an amino acid sequence of SEQ ID NO: 3012. In certain embodiments, the constant chain of human TCRa encoded by the SIR molecule comprises the amino acid sequence of SEQ ID NO: 3012.

In certain embodiments, the nucleic acid sequence of the SIR molecule comprises the nucleic acid sequence of human T cell receptor alpha (TCR-alpha or TCRα or TCRa or hTCRa or hTCRα or Cα) constant chain as shown in SEQ ID NO: 737. In certain embodiments, the nucleic acid sequence of the SIR molecule encodes for constant chain of human TCRa carrying amino acid substitutions (SDVP) that enhance the expression of the encoded polypeptide. In certain embodiments, the nucleotide sequence of the SIR comprises sequence that encodes for amino acid sequence of constant chain of human T cell receptor alpha (TCR-alpha or TCRα or TCRa or Cα) having at least one, five or ten modifications but not more than 20 modifications of an amino acid sequence of SEQ ID NO: 3017, or a sequence with 80-99% identity to an amino acid sequence of SEQ ID NO: 3017. In certain embodiments, the constant chain of human TCRa encoded by the SIR molecule comprises the amino acid sequence of SEQ ID NO: 3017.

In certain embodiments, the nucleic acid sequence of the SIR molecule comprises the nucleic acid sequence of human T cell receptor alpha (TCR-alpha or TCRα or TCRa or hTCRa or hTCRα or Cα) constant chain as shown in SEQ ID NO: 740. In certain embodiments, the nucleic acid sequence of the SIR molecule encodes for constant chain of human TCRa carrying amino acid substitutions (SD) that enhance the expression of the encoded polypeptide. In certain embodiments, the nucleic acid sequence of the SIR comprises sequence that encodes for amino acid sequence of constant chain of human T cell receptor alpha (TCR-alpha or TCRα or TCRa or Cα) having at least one, five or ten modifications but not more than 20 modifications of an amino acid sequence of SEQ ID NO: 3020, or a sequence with 80-99% identity to an amino acid sequence of SEQ ID NO: 3020. In certain embodiments, the constant chain of human TCRa encoded by the SIR molecule comprises the amino acid sequence of SEQ ID NO: 3020.

In certain embodiments, the nucleic acid sequence of the SIR molecule comprises the nucleic acid sequence of human T cell receptor alpha (TCR-alpha or TCRα or TCRa or hTCRa or hTCRα or Cα) constant chain as shown in SEQ ID NO: 736. In certain embodiments, the nucleic acid sequence of the SIR molecule encodes for the constant chain of human TCRα with a Thr 48 Cys (T48C) substitution that promotes the formation of an additional interchain disulfide bond when coexpressed with an introduced mutant human TCRβ constant chain that carries a S57C (Ser57cys) substitution, and reduces chain-pairing with the endogenous TCRβ chain. In certain embodiments, the nucleic acid sequence of the SIR comprises sequence that encodes for amino acid sequence of constant chain of human T cell receptor alpha (TCR-alpha or TCRα or TCRa or Cα) having at least one, five or nine modifications but not more than 20 modifications of an amino acid sequence of SEQ ID NO: 3016, or a sequence with 80-99% identity to an amino acid sequence of SEQ ID NO: 3016. In certain embodiments, the constant chain of human TCRa encoded by the SIR molecule comprises the amino acid sequence of SEQ ID NO: 3016.

In certain embodiments, the nucleic acid sequence of the SIR molecule comprises the nucleic acid sequence of human T cell receptor alpha (TCR-alpha or TCRα or TCRa or hTCRa or hTCRα or Cα) constant chain as shown in SEQ ID NO: 738. In certain embodiments, the nucleic acid sequence of the SIR molecule encodes for the constant chain of human TCRα with a Ser 61 Arg (S61R) substitution that promotes chain-pairing when coexpressed with an introduced mutant human TCRβ constant chain that carries a R79G (Arg79Gly) substitution and reduce chain-pairing with the endogenous TCRβ chain. In certain embodiments, the nucleic acid sequence of the SIR comprises sequence that encodes for amino acid sequence of constant chain of human T cell receptor alpha (TCR-alpha or TCRα or TCRa or Cα) having at least one, five or nine modifications but not more than 20 modifications of an amino acid sequence of SEQ ID NO: 3018, or a sequence with 80-99% identity to an amino acid sequence of SEQ ID NO: 3018. In certain embodiments, the constant chain of human TCRa encoded by the SIR molecule comprises the amino acid sequence of SEQ ID NO: 3018.

In certain embodiments, the nucleic acid sequence of the SIR molecule comprises the nucleic acid sequence of human T cell receptor alpha (TCR-alpha or TCRα or TCRa or hTCRa or hTCRα or Cα) constant chain as shown in SEQ ID NO: 739. In certain embodiments, the nucleic acid sequence of the SIR molecule encodes for constant chain of human TCRa carrying amino acid substitutions (SDVPR)

that enhance the expression of the encoded polypeptide and its pairing with the complementary TCRβ constant chain reduce chain-pairing with the endogenous TCRβ chain. In certain embodiments, the nucleotide sequence of the SIR comprises sequence that encodes for amino acid sequence of constant chain of human T cell receptor alpha (TCR-alpha or TCRα or TCRa or Cα) having at least one, five or ten modifications but not more than 20 modifications of an amino acid sequence of SEQ ID NO: 3019, or a sequence with 80-99% identity to an amino acid sequence of SEQ ID NO: 3019. In certain embodiments, the constant chain of human TCRa encoded by the SIR molecule comprises the amino acid sequence of SEQ ID NO: 3019.

In certain embodiments, the nucleic acid sequence of the SIR molecule comprises the nucleic acid sequence of human T cell receptor beta (TCR-beta or TCRb or TCRβ or hTCR-beta or hTCRb or hTCRβ or Cβ) constant chain as shown in SEQ ID NO: 744 or SEQ ID NO:745. In certain embodiments, the nucleotide sequence of the SIR encodes for amino acid sequence of constant chain of human T cell receptor beta having at least one, five or nine modifications but not more than 20 modifications of an amino acid sequence of SEQ ID NO: 3024 or SEQ ID NO: 3025 or a sequence with 80-99% identity to an amino acid sequence of SEQ ID NO: SEQ ID NO: 3024 or SEQ ID NO: 3025. In certain embodiments, the constant chain of human TCRb encoded by the SIR molecule comprises the amino acid sequence of SEQ ID NO: SEQ ID NO: 3024 or SEQ ID NO: 3025.

In certain embodiments, the nucleic acid sequence of the SIR molecule comprises the nucleic acid sequence of human T cell receptor beta (TCR-beta or TCRb or TCRβ or hTCR-beta or hTCRb or hTCRβ or Cβ) constant chain encoding amino acid sequence of SEQ ID NO: 3024 or SEQ ID NO: 3025, but carrying one or more mutations including a basic amino acid (Arg or Lys) at position 18, an alanine (A) at position 22, an isoleucine (I) at position 133, an alanine (A) at position 136, a histidine (H) at position 139, a cysteine (C) at position 57, and/or a Glycine (G) at position 79.

In certain embodiments, the nucleic acid sequence of the SIR molecule comprises the nucleic acid sequence of human T cell receptor beta (TCR-beta or TCRb or TCRβ or hTCR-beta or hTCRb or hTCRβ or Cβ) constant chain encoding amino acid sequence of constant chains of human TCRβ1 (SEQ ID NO: 3024) or TCRβ2 (SEQ ID NO; 3025) but in which one or more amino acids are replaced by the corresponding amino acids of mouse TCRβ constant chain (SEQ ID NO: 3047).

In certain embodiments, the nucleic acid sequence of the SIR molecule comprises the nucleic acid sequence of human T cell receptor beta (TCR-beta or TCRb or TCRβ or hTCR-beta or hTCRb or hTCRβ or Cβ) constant chain as shown in SEQ ID NO: 748. In certain embodiments, the nucleic acid sequence of the SIR molecule encodes for constant chain of human TCRb carrying amino acid substitutions (KACIAH) as shown in SEQ ID NO:3028 that enhance the expression and chain-pairing of the encoded polypeptide with the complementary TCRa constant chain of the SIR, and reduce chain-pairing with the endogenous TCRa chain. In certain embodiments, the nucleic acid sequence of the SIR comprises sequence that encodes for amino acid sequence of constant chain of human TCRb having at least one, five or ten modifications but not more than 20 modifications of an amino acid sequence of SEQ ID NO: 3028, or a sequence with 80-99% identity to an amino acid sequence of SEQ ID NO:3028. In certain embodiments, the constant chain of human TCRb encoded by the SIR molecule comprises the amino acid sequence of SEQ ID NO: 3028.

In certain embodiments, the nucleic acid sequence of the SIR molecule comprises the nucleic acid sequence of human T cell receptor beta (TCR-beta or TCRb or TCRβ or hTCR-beta or hTCRb or hTCRβ or Cβ) constant chain as shown in SEQ ID NO: 747. In certain embodiments, the nucleic acid sequence of the SIR molecule encodes for constant chain of human TCRb carrying a Ser 57 Cys (S57C) substitution as shown in SEQ ID NO: 3027 that promotes the formation of an additional interchain disulfide bond when coexpressed with a mutant human TCRα constant chain that carries a T48C (Thr57cys) substitution and reduces chain-pairing with the endogenous TCRα chain. In certain embodiments, the nucleic acid sequence of the SIR comprises sequence that encodes for amino acid sequence of constant chain of human TCRb having at least one, five or ten modifications but not more than 20 modifications of an amino acid sequence of SEQ ID NO: 3027, or a sequence with 80-99% identity to an amino acid sequence of SEQ ID NO: 3027. In certain embodiments, the constant chain of human TCRb2 encoded by the SIR molecule comprises the amino acid sequence of SEQ ID NO: 3027.

In certain embodiments, the nucleic acid sequence of the SIR molecule comprises the nucleic acid sequence of human T cell receptor beta (TCR-beta or TCRb or TCRβ or hTCR-beta or hTCRb or hTCRβ or Cβ) constant chain as shown in SEQ ID NO: 762. In certain embodiments, the nucleic acid sequence of the SIR molecule encodes for constant chain of human TCRb carrying an Arg 79 Gly (R79G) substitution as shown in SEQ ID NO: 3042 that promotes chain-pairing with an introduced mutant human TCRα constant chain that carries a Ser 61 Arg (S61R) substitution and reduces chain-pairing with the endogenous TCRα chain. In certain embodiments, the nucleic acid sequence of the SIR comprises sequence that encodes for amino acid sequence of constant chain of human T cell receptor beta having at least one, five or ten modifications but not more than 20 modifications of an amino acid sequence of SEQ ID NO: 3042, or a sequence with 80-99% identity to an amino acid sequence of SEQ ID NO: 3042. In certain embodiments, the constant chain of human TCRb encoded by the SIR molecule comprises the amino acid sequence of SEQ ID NO: 3042.

In certain embodiments, the nucleic acid sequence of the SIR molecule comprises the nucleic acid sequence of human T cell receptor beta (TCR-beta or TCRb or TCRβ or hTCR-beta or hTCRb or hTCRβ or Cβ) constant chain as shown in SEQ ID NO: 753 to 759. In certain embodiments, the nucleic acid sequence of the SIR molecule encodes for constant chain of human TCRb carrying amino acid substitutions as shown in SEQ ID NO: 3034, 3035, 3036, 3037, 3038 or 3039 that enhance its expression. In certain embodiments, the nucleic acid sequence of the SIR comprises sequence that encodes for amino acid sequence of constant chain of human T cell receptor beta having at least one, five or ten modifications but not more than 20 modifications of an amino acid sequence of SEQ ID NO: 3034 to 3038 or 3039 or a sequence with 80-99% identity to an amino acid sequence of SEQ ID NO: 3034, 3035, 3036, 3037, 3038 or 3039. In certain embodiments, the constant chain of human TCRb encoded by the SIR molecule comprises the amino acid sequence of SEQ ID NO: 3034, 3035, 3036, 3037, 3038 or 3039.

In certain embodiments, the nucleic acid sequence of the SIR molecule comprises the nucleic acid sequence of human T cell receptor beta (TCR-beta or TCRb or TCRβ or hTCR-beta or hTCRb or hTCRβ or Cβ) constant chain as shown in SEQ ID NO: 753. In certain embodiments, the nucleic acid sequence of the SIR molecule encodes for constant chain of human TCRb carrying amino acid substitutions (KAIAH) as shown in SEQ ID NO: 3033 that enhance its expression. In certain embodiments, the nucleic acid sequence of the SIR comprises sequence that encodes for amino acid sequence of constant chain of human T cell receptor beta having at least one, five or ten modifications but not more than 20 modifications of an amino acid sequence of SEQ ID NO: 3033, or a sequence with 80-99% identity to an amino acid sequence of SEQ ID NO: 3033. In certain embodiments, the constant chain of human TCRb encoded by the SIR molecule comprises the amino acid sequence of SEQ ID NO: 3033.

In certain embodiments, the nucleic acid sequence of the SIR molecule comprises the nucleic acid sequence of human T cell receptor beta (TCR-beta or TCRb or TCRβ or hTCR-beta or hTCRb or hTCRβ or Cβ) constant chain as shown in SEQ ID NO: 761. In certain embodiments, the nucleic acid sequence of the SIR molecule encodes for constant chain of human TCRb carrying amino acid substitutions (KAG) as shown in SEQ ID NO:3041 that enhance its expression and pairing with the introduced TCRa constant chain. In certain embodiments, the nucleotide sequence of the SIR comprises sequence that encodes for amino acid sequence of constant chain of human T cell receptor beta having at least one, five or ten modifications but not more than 20 modifications of an amino acid sequence of SEQ ID NO: 3041, or a sequence with 80-99% identity to an amino acid sequence of SEQ ID NO:3041. In certain embodiments, the constant chain of human TCRb encoded by the SIR molecule comprises the amino acid sequence of SEQ ID NO: 3041.

In certain embodiments, the nucleic acid sequence of the SIR molecule comprises the nucleic acid sequence of human T cell receptor beta (TCR-beta or TCRb or TCRβ or hTCR-beta or hTCRb or hTCRβ or Cβ) constant chain as shown in SEQ ID NO: 760. In certain embodiments, the nucleic acid sequence of the SIR molecule encodes for constant chain of human TCRb carrying amino acid substitutions (KAIHAG) as shown in SEQ ID NO:3040 that enhance its expression and pairing with the introduced TCRa constant chain. In certain embodiments, the nucleotide sequence of the SIR comprises sequence that encodes for amino acid sequence of constant chain of human T cell receptor beta having at least one, five or ten modifications but not more than 20 modifications of an amino acid sequence of SEQ ID NO: 3040, or a sequence with 80-99% identity to an amino acid sequence of SEQ ID NO: 3040. In certain embodiments, the constant chain of human TCRb encoded by the SIR molecule comprises the amino acid sequence of SEQ ID NO: 3040.

In certain embodiments, the nucleic acid sequence of the SIR molecule comprises a sequence of SEQ ID NO: 755, 756, 757, 758 or 759 which encodes for constant chain of human TCRb2 carrying amino acid substitutions (K18I133 or K18A136 or K18A136 or K18H139 or R18A22 or R18) that enhance its expression and pairing with the introduced TCRa constant chain. In certain embodiments, the nucleotide sequence of the SIR comprises sequence that encodes for amino acid sequence of constant chain of human T cell receptor beta2 (TCR-beta2 or TCRβ2 or TCRb2 or Cβ2; also designated TCR-beta, TCRβ or TCRb or Cβ) having at least one, five or ten modifications but not more than 20 modifications of an amino acid sequence of SEQ ID NO: 3035, 3036, 3037, 3038 or 3039, or a sequence with 80-99% identity to an amino acid sequence of SEQ ID NO: 3035, 3036, 3037, 3038 or 3039. In certain embodiments, the constant chain of human TCRb2 encoded by the SIR molecule comprises the amino acid sequence of SEQ ID NO: 3035, 3036, 3037, 3038 or 3039.

In certain embodiments, the nucleic acid sequence of the SIR encodes for amino acid sequence of constant chain of human pre T cell receptor alpha that is missing the C-terminal 48 amino acids (pre-TCR-alpha-Del48 or pre-TCRα-Del48 or pre-TCRa-Del48 or preCα-Del48) and having a nucleic acid sequence as shown in SEQ ID NO: 768. In certain embodiments, the nucleic acid sequence of the SIR encodes for amino acid sequence of preCα-Del48 constant chain having at least one, five or nine modifications but not more than 20 modifications of an amino acid sequence of SEQ ID NO:3048, or a sequence with 80-99% identity to an amino acid sequence of SEQ ID NO:3048. In certain embodiments, the constant chain of human pre-TCRa-Del48 encoded by the SIR molecule comprises the amino acid sequence of SEQ ID NO: 3048.

In certain embodiments, the nucleic acid sequence of the SIR molecule comprises the nucleic acid sequence of constant chain of human pre T cell receptor alpha (pre-TCR-alpha or pre-TCRα or pre-TCRa or preCα) as shown in SEQ ID NO: 766 or 767. In certain embodiments, the nucleic acid sequence of the SIR encodes for amino acid sequence of constant chain of human pre T cell receptor alpha as shown in SEQ ID NO: 3046 or 3047 and having at least one, five or nine modifications but not more than 20 modifications of an amino acid sequence of SEQ ID NO: 3046 or 3047, or a sequence with 80-99% identity to an amino acid sequence of SEQ ID NO: 3046 or 3047. In certain embodiments, the constant chain of human pre-TCRa encoded by the SIR molecule comprises the amino acid sequence of SEQ ID NO: 3046 or 3047.

In certain embodiments, the nucleic acid sequence of the SIR molecule comprises the nucleic acid sequence of constant chain of human T cell receptor gamma (TCR-gamma or TCRγ or TCRg or hTCR-gamma, or hTCRγ or hTCRg or Cγ) as shown in SEQ ID NO: 769 or 770. In certain embodiments, the nucleic acid sequence of the SIR encodes for amino acid sequence of constant chain of human T cell receptor gamma and having at least one, five or nine modifications but not more than 20 modifications of an amino acid sequence of SEQ ID NO: 3049 or 3050, or a sequence with 80-99% identity to an amino acid sequence of SEQ ID NO: 3049 or 3050. In certain embodiments, the constant chain of human TCRg encoded by the SIR molecule comprises the amino acid sequence of SEQ ID NO: 3049 or 3050.

In certain embodiments, the nucleic acid sequence of the SIR molecule comprises the nucleic acid sequence of constant chain of human T cell receptor delta (TCR-delta or TCRδ or TCRd or hTCR-delta, or hTCRδ, or hTCRd or Cδ) as shown in SEQ ID NO: 771 or 772. In certain embodiments, the nucleic acid sequence of the SIR encodes for amino acid sequence of constant chain of human T cell receptor delta as shown in SEQ ID NO: 3052 and having at least one, five or nine modifications but not more than 20 modifications of an amino acid sequence of SEQ ID NO: 3052, or a sequence with 80-99% identity to an amino acid sequence of SEQ ID NO: 3052. In certain embodiments, the constant chain of human TCR-delta encoded by the SIR molecule comprises the amino acid sequence of SEQ ID NO: 3052.

In certain embodiments, the nucleic acid sequence of the SIR molecule comprises the nucleic acid sequence of constant chain of canine T cell receptor alpha (canineTCR-alpha or canineTCRα or canineTCRa or canine or cTCRalpha, or cTCRα or cTCRa or cCα) as shown in SEQ ID NO: 743. In certain embodiments, the nucleic acid sequence of the SIR encodes for amino acid sequence of constant chain of canine T cell receptor alpha as shown in SEQ ID NO: 3023 and having at least one, five or nine modifications but not more than 20 modifications of an amino acid sequence of SEQ ID NO: 3023, or a sequence with 80-99% identity to an amino acid sequence of SEQ ID NO: 3023. In certain embodiments, the constant chain of canine TCR-alpha encoded by the SIR molecule comprises the amino acid sequence of SEQ ID NO: 3023.

In certain embodiments, the nucleic acid sequence of the SIR molecule comprises the nucleic acid sequence of constant chain of canine T cell receptor beta (canine-TCR-beta or canine-TCRβ or canine-TCRb or canine-Cβ or cTCR-beta, or cTCRβ or cTCRb or cCβ) as shown in SEQ ID NO: 764. In certain embodiments, the nucleic acid sequence of the SIR encodes for amino acid sequence of constant chain of canine T cell receptor beta as shown in SEQ ID NO: 3044 and having at least one, five or nine modifications but not more than 20 modifications of an amino acid sequence of SEQ ID NO: 3044, or a sequence with 80-99% identity to an amino acid sequence of SEQ ID NO:3044. In certain embodiments, the constant chain of canine TCR-beta encoded by the SIR molecule comprises the amino acid sequence of SEQ ID NO: 3044.

In certain embodiments, the nucleic acid sequence of the SIR molecule comprises the nucleic acid sequence of constant chain of murine T cell receptor alpha (murineTCR-alpha or murine TCRα or murine TCRa or murine-Cα or mTCRalpha, or mTCRα or mTCRa or mCα) as shown in SEQ ID NO:742. In certain embodiments, the nucleic acid sequence of the SIR encodes for amino acid sequence of constant chain of murine T cell receptor alpha as shown in SEQ ID NO: 3022 and having at least one, five or nine modifications but not more than 20 modifications of an amino acid sequence of SEQ ID NO: 3022, or a sequence with 80-99% identity to an amino acid sequence of SEQ ID NO:3022. In certain embodiments, the constant chain of murine TCR-alpha encoded by the SIR molecule comprises the amino acid sequence of SEQ ID NO: 3022.

In certain embodiments, the nucleic acid sequence of the SIR molecule comprises the nucleic acid sequence of constant chain of murine T cell receptor beta (murine TCR-beta or murine TCRβ or murine TCRβ or murine-Cβ or mTCR-beta, or mTCRβ or mTCRb or mCβ) as shown in SEQ ID NO:763. In certain embodiments, the nucleic acid sequence of the SIR encodes for amino acid sequence of constant chain of murine T cell receptor beta as shown in SEQ ID NO: 3043 and having at least one, five or nine modifications but not more than 20 modifications of an amino acid sequence of SEQ ID NO: 3043, or a sequence with 80-99% identity of an amino acid sequence of SEQ ID NO: 3043. In certain embodiments, the constant chain of murine TCR-beta encoded by the SIR molecule comprises the amino acid sequence of SEQ ID NO: 3043.

In certain embodiments, the nucleic acid sequence of the SIR molecule comprises the nucleic acid sequence of human TCRa constant chain extracellular domain in fusion with the extracellular domain, transmembrane domain and cytosolic domain of human CD3zeta (CD3ζ) chain as shown in SEQ ID NO:741. In certain embodiments, the nucleic acid sequence of the SIR encodes for amino acid sequence as shown in SEQ ID NO: 3021 and having at least one, five or nine modifications but not more than 20 modifications of an amino acid sequence of SEQ ID NO: 3021, or a sequence with 80-99% identity to an amino acid sequence of SEQ ID NO: 3021. In certain embodiments, the constant chain of human TCRa constant chain extracellular domain in fusion with the extracellular domain, transmembrane domain and cytosolic domain of human CD3zeta (CD3ζ) encoded by the SIR molecule comprises the amino acid sequence of SEQ ID NO:3021.

In certain embodiments, the nucleic acid sequence of the SIR molecule comprises the nucleic acid sequence of constant chain of human TCRb constant chain extracellular domain in fusion with the extracellular domain, transmembrane domain and cytosolic domain of human CD3zeta (CD3ζ) chain as shown in SEQ ID NO:765. In certain embodiments, the nucleic acid sequence of the SIR encodes for amino acid sequence as shown in SEQ ID NO: 3045 and having at least one, five or nine modifications but not more than 20 modifications of an amino acid sequence of SEQ ID NO: 3045, or a sequence with 80-99% identity to an amino acid sequence of SEQ ID NO: 3045. In certain embodiments, the constant chain of human TCRa constant chain extracellular domain in fusion with the extracellular domain, transmembrane domain and cytosolic domain of human CD3zeta (CD3ζ) encoded by the SIR molecule comprises the amino acid sequence of SEQ ID NO: 3045.

In certain embodiments, the nucleic acids encoding the SIRs of the disclosure encode for a single T cell receptor constant chain comprising or derived from constant chains of either TCRa, TCRb, pre-TCRa, TCR-gamma, or TCR-delta chains of human, mouse or canine origin. An exemplary SIR with a single TCR constant chain is represented by Clone ID: 051216-F04, whose nucleic acid and amino acid sequences are given in SEQ ID NO: 1023 and 3258, respectively.

In certain embodiments, the nucleic acids encoding the SIRs of the disclosure encode for two T cell receptor constant chains comprising or derived from TCRa, TCRb, pre-TCRa, TCR-gamma, or TCR-delta chains of human, mouse or canine origin. An exemplary SIR with a two TCR constant chain is represented by Clone ID: 102615-C08, whose nucleic acid and amino acid sequences are given in SEQ ID NO: 1200 and 3435, respectively.

In certain embodiments, the two T cell receptor constant chains of the SIR could be of the same type (e.g., TCRa/TCRa; TCRb/TCRb; preTCRa/preTCRa; TCRgamma/TCRgamma; and TCR-delta/TCR-delta). An exemplary SIR with the two TCR constant chains of the same type is Clone ID: 021116-E08 (SEQ ID NO:905), Clone ID: 012216-P08 (SEQ ID NO:906), Clone ID NO:012216-Q05 (SEQ ID NO:907), Clone ID NO:012216-R04 (SEQ ID NO:908) and Clone ID NO:012216-S02 (SEQ ID NO:909). In another embodiment, the two T cell receptor constant chains of the SIR are of different types (e.g., TCRa/TCRb; preTCRa/TCRb; TCRgamma/TCR-delta, etc.). An exemplary SIR with two TCR constant chain of different types is represented by Clone ID: 102615-C08, whose nucleic acid and amino acid sequences are given in SEQ ID NO: 1200 and 3435, respectively.

As mentioned above, the SIRs of the disclosure comprise a TCR domain linked to an antigen binding domain. Accordingly, SIRs of the disclosure can comprise one or more antigen binding domains (e.g., antibody or antibody fragment, a ligand or a receptor) and one or more T cell receptor constant chains (as described herein and above), wherein said antigen binding domain or domains binds to a target antigen. Non-limiting exemplary target antigens include: CD19; CD123; CD22; CD23, CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8)aNeu5Ac (2-3)bDGalp(l-4)bDGlcp(l-l)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); Fins Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-llRa); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha (FRa or FR1); Folate receptor beta (FRb); Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); sialyl Lewis adhesion molecule (sLe); ganglioside GM3 (aNeu5Ac(2-3)bD-Clalp(l-4)bDGlcp(l-1)Cer); transglutaminase 5 (TGS5); high molecular weight-melanoma associated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ES0-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member lA (XAGEl); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCTA-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B 1 (CYPlB 1); CCCTC-Binding Factor (Zinc Finger Protein)-Like (BORIS or Brother of the Regulator oflm printed Sites), Squamous Cell Carcinoma Antigen Recognized By T Cells 3 (SART3); Paired box protein Pax-5 (PAX5); proacrosin binding protein sp32 (OY-TESl); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRl); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen); Fucosyl-GM1, PTK7, gpNMB, CDH1-CD324, DLL3, CD276/B7H3, IL11Ra, IL13Ra2, CD179b-IGLl1, TCRgamma-delta, NKG2D, CD32 (FCGR2A), Tn ag, Tim1-/HVCR1, CSF2RA (GM-CSFR-alpha), TGF-betaR2, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Chorionic Gonadotropin Hormone receptor (CGHR), CCR4, GD3, SLAMF6, SLAMF4, HIV1 envelope glycoprotein, HTLV1-Tax, CMV pp65, EBV-EBNA3c, KSHV K8.1, KSHV-gH, influenza A hemagglutinin (HA), GAD, PDL1, GUANYLYL CYCLASE C (GCC), autoantibody to desmoglein 3 (Dsg3), autoantibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IGE, CD99, RAS G12V, TISSUE FACTOR 1 (TF1), AFP, GPRC5D, CLAUDIN18.2 (CLD18A2 OR CLDN18A.2)), P-GLYCOPROTEIN, STEAP1, LIV1, NECTIN-4, CRIPTO, GPA33, BST1/CD157, LOW CONDUCTANCE CHLORIDE CHANNEL, and antigen recognized by TNT antibody.

In some embodiments, the antigen binding domain of the SIR polypeptide molecule binds to a tumor antigen. Non-limiting examples of tumor antigens that can be targeted by a SIR polypeptide include TSHR, CD 171, CS-1, CLL-1, GD3, Tn Ag, FLT3, CD38, CD44v6, B7H3, KIT, IL-13Ra2, IL-11Ra, PSCA, PRSS21, VEGFR2, LewisY, CD24, PDGFR-beta, SSEA-4, MUC1, EGFR, NCAM, CAIX, LMP2, EphA2, Fucosyl GM1, sLe, GM3, TGS5, HMW-MAA, o-acetyl-GD2, Folate receptor beta, TEM1/CD248, TEM7R, CLDN6, GPRC5D, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, ETV6-AML, sperm protein 17, XAGE1, Tie 2, MAD-CT-1, MAD-CT-2, Fos-related antigen 1, p53 mutant, hTERT, sarcoma translocation breakpoints, ML-IAP, ERG (TMPRSS2 ETS fusion gene), NA17, PAX3, Androgen receptor, Cyclin B1, MYCN, RhoC, CYP1B1, BORIS, SART3, PAX5, OY-TES1, LCK, AKAP-4, SSX2, CD79a, CD79b, CD72, LAIR1, FCAR, LILRA2, CD300LF, CLEC12A, BST2, EMR2, LY75, GPC3, FCRL5, and IGLL1.

In some embodiments, the antigen binding domain of the SIR polypeptide molecule binds to an antigen in association with HLA-A2. Non-limiting examples of antigens that are recognized in association with HLA-A2 include TARP, WT1, hTERT, gp100, Tyrosinase, MART1, NY-ESO1, CMV pp65, EBV EBNA3c, HIV1 gag, HTLV1-Tax, PR1, CMV pp65, EBV-EBNA3c, Ras G12V mutant, and GAD.

In some embodiments, the antigen binding domain of the SIR polypeptide molecule comprises of an autoantigen or a fragment thereof that binds to an autoantibody. Non-limiting examples of autoantigen include Dsg1 and Dsg3.

In some embodiments, the antigen binding domain of the SIR polypeptide molecule is derived from or comprises wild-type or non-wild-type sequence of an antibody, an antibody fragment, an scFv, a Fv, a Fab, a (Fab')2, a single domain antibody (SDAB), a vH or vL domain, a camelid VHH domain, or a non-immunoglobulin scaffold such as a DARPIN, an affibody, an affilin, an adnectin, an affitin, an obodies, a repebody, a fynomer, an alphabody, an avimer, an atrimer, a centyrin, a pronectin, an anticalin, a kunitz domain, an Armadillo repeat protein, an autoantigen, a receptor or a ligand. In some embodiments, the encoded SIR polypeptide contains more than one antigen binding domains. In embodiments, the antigen binding domain is operably linked directly or via an optional linker to the NH2-terminal end of a TCR domain (i.e. constant chains of TCR-alpha, TCR-beta1, TCR-beta2, preTCR-alpha, pre-TCR-alpha-Del48, TCR-gamma, or TCR-delta). The nucleic acid and amino acid sequences of several exemplary linkers are provided in SEQ ID NO: 701-725, 18922-18927 and 2981-3003, 18929-18934. A construct encoding an exemplary such SIR is provided in Clone ID NO: 082815-G07. The amino acid sequence of the encoded SIR polypeptide corresponds to SEQ ID NO: 3855.

In some embodiments, the antigen binding domain of a SIR polypeptide molecule is derived from or comprises of vL and vH domains of an antibody that are separately attached to the NH2-terminus of two constant chains of a T cell receptor (i.e. constant chains of TCR-alpha, TCR-beta1, TCR-beta2, preTCR-alpha, pre-TCR-alpha-Del48, TCR-gamma, or TCR-delta, or mutants or variant thereof as described herein) to jointly constitute a single antigen binding domain. An exemplary such SIR which targets CD19 is provided in Clone ID NO: 102615-C08. The amino acid sequence of this SIR corresponds to SEQ ID NO: 3435. In this SIR, the vL fragment derived from FMC63, a CD19 monoclonal antibody, is attached to constant region of a mutant (KACIAH) human TCRb chain via a linker while the vH fragment derived from the FMC63 monoclonal antibody is attached via a linker to the constant region of a mutant (CSDVP) human TCRα chain.

In some embodiments, the SIR polypeptide has two or more antigen binding domains that are derived from or are comprised of antibodies that are expressed as single chain variable fragments (scFv) and are separately joined to the NH2-termini of two constant chains of a T cell receptor (i.e., constant chains of TCR-alpha, TCR-beta1, TCR-beta2, preTCR-alpha, pre-TCR-alpha-Del48, TCR-gamma, or TCR-delta, variants or mutants thereof). In some embodiments, the two (or more) antigen binding domains of the encoded SIR molecule are encoded by nucleotide sequences encoding two single chain variable fragments (scFv) that are fused in frame to two constant chains derived from T cell receptors (i.e. constant chains of TCR-alpha, TCR-beta1, TCR-beta2, preTCR-alpha, pre-TCR-alpha-Del48, TCR-gamma, or TCR-delta). The encoded two scFv fragments may target the same antigen (i.e. unispecific SIR) or different antigens (i.e. bispecific or multispecific SIR). In the case of a unispecific SIR, the two scFv may encode for polypeptides with identical amino acid sequences or different amino acid sequences. Furthermore, in the case of a unispecific SIR, where the two scFv are encoded by polypeptides with identical amino acid sequences, the nucleotide sequences encoding the two identical scFVs polypeptides may be identical or non-identical. An exemplary unispecific SIR with two scFvs is represented by SEQ ID NO: 1026. The two antigen binding domains of this SIR are comprised of scFvs derived from two different monoclonal antibodies, CD19Bu12 and FMC63, targeting the human CD19 antigen. An exemplary multispecific SIR with two scFvs is represented by SEQ ID NO: 1028. The two antigen binding domains of this SIR are comprised of scFvs derived from two different monoclonal antibodies, CD19Bu12 and CD20-2F2, targeting the human CD19 and CD20 antigens, respectively. An example of such a SIR is represented by 040716-B04 (CD8SP-CD19Bu12-scFv-V5-[hTCRb-KACIAH]-F-P2A-SP-CD20-2F2-scFv-Myc-[hTCRa-CSDVP]-F-F2A-PAC) which targets CD19 and CD20 and the corresponding amino acid sequence is represented by SEQ ID NO: 1028.

An exemplary SIR with two binding domains is represented by 040716-B04 (CD8SP-CD19Bu12-scFv-V5-[hTCRb-KACIAH]-F-P2A-SP-CD20-2F2-scFv-Myc-[hTCRa-CSDVP]-F-F2A-PAC) which targets CD19 and CD20 having the corresponding amino acid sequence represented by SEQ ID NO: 1028. The two scFv polypeptide fragments may target the same antigen (i.e. unispecific SIR) or different antigens (i.e. bispecific or multispecific SIR). In the case of a unispecific SIR, the two scFv may have identical amino acid sequences or different amino acid sequences. Exemplary SIR that target two different antigens are represented by SEQ ID NO: 1028 and 1163.

In certain embodiments, the antigen binding domain of the two SIR polypeptides are similar in structure (e.g., both antigen binding domains are scFv or camelid VHH domain or affibodies or vL or vH). For example, the antigen binding domain of the first SIR polypeptide comprises a camelid VHH domain targeting Her2 and the antigen binding domain of the second SIR polypeptide comprise a VHH domain targeting Her3. A SIR in which both the antigen binding domains are composed of vL chains is CD8SP-FMC63-11-vL-V5-[TCRb-KACIAH]-F-P2A-FMC63vL-Myc-[TCRa-CSDVP]-F-F2A-PAC and is represented by SEQ ID NO: 10474. In one embodiment, the antigen binding domains of the two SIR polypeptides are not similar in structure (e.g., the first antigen binding domain is a scFv and the second antigen binding domain is a camelid VHH). An exemplary such SIR is CD8SP-IL6R-304-vHH-V5-[hTCRb-KACIAH]-F-P2A-SP-FMC63-vL-Gly-Ser-Gly-linker-vH-MYC-[hTCRa-CSDVP]-F-F2A-PAC (SEQ ID NO: 1166). In certain embodiments, the antigen binding domain of the first SIR polypeptide (functional polypeptide unit 1) comprises a camelid VHH domain targeting CD123 and the antigen binding domain of the second SIR polypeptide (functional polypeptide unit 2) comprise a scFv targeting MPL.

In some embodiments, the antigen binding domain of the encoded SIR polypeptides is encoded by a codon optimized nucleotide sequence of the corresponding wild-type sequence or a non-wild-type sequence antibody, single domain antibodies (SDAB), VH domains, VL domain, camelid VHH domains, or a non-immunoglobulin scaffolds such as DARPINs, affibodies, affilins, adnectins, affitins, obodies, repebodies, fynomers, alphabodies, avimers, atrimers, centyrins, pronectins, anticalins, kunitz domains, Armadillo repeat proteins, autoantigen, receptors or ligands.

In some embodiments, the encoded one or more antigen binding domains of the SIR polypeptide comprise any one or more of light chain variable domain (vL or VL) amino acid sequences of SEQ ID NO 2307 to 2482 and 12042 to 12159 wherein up to 9 amino acid residues but no more than 10 amino acids are replaced by any other amino acid residues, or sequences with 80-100% identity to amino acid sequences of SEQ ID NO 2307 to 2482 and 12042 to 12159, or sequences with 98-100% identity to the complementarity determining regions (CDR's) of SEQ ID NO 2307 to 2482 and 12042 to 12159. Table 5 shows the target antigens, names, SEQ ID NO (DNA), SEQ ID NO (PRT), SEQ ID NO (PRT) of CDR1-3 of the exemplary vL domains used in this disclosure.

In some embodiments, the encoded one or more antigen binding domains of the SIR polypeptide comprise any one or more of heavy chain variable domain (vH or VH) amino acid sequences of SEQ ID NO 2506 to 2680 and 12160 to 12278 wherein up to 9 amino acid residues but no more than 10 amino acids are replaced by any other amino acid residues, or sequences with 80-100% identity to amino acid sequences of SEQ ID NO 2506 to 2680 and 12160 to 12278, or sequences with 98-100% identity to the complementarity determining regions (CDR's) of SEQ ID NO 2506 to 2680 and 12160 to 12278. Table 5 shows the target antigens, shows the target antigens, names, SEQ ID NO (DNA), SEQ ID NO (PRT), SEQ ID NO (PRT) of CDR1-3 of the exemplary vH domains used in this disclosure. The name of a vH fragments can be used to identify the corresponding vL fragment based on the name of the latter. For example, the vH fragment Alk-48-vH (SEQ ID NO: 226) is derived from the same antibody or scFv as the vL fragment Alk-48-vL (SEQ ID NO: 16) and the two components can be used together to make an scFv or a SIR targeting ALK. In certain cases the Table 5 lists two or more vL or vH fragments with identical names followed by a number, such as FMC63 (SEQ ID NO: 30), FMC63-[2]-vL (SEQ ID NO: 31) and FMC63-[3]-vL (SEQ ID NO: 32). In such cases, any one of the above FMC63 vL chains can be joined to any one of the FMC63-vH chains (SEQ ID NO: 241 and 242) to develop the corresponding SIR based on the FMC63-based binding domain.

In some embodiments, the encoded one or more antigen binding domains of the SIR polypeptide comprise any one or more of camelid single domain antibody (vHH or VHH) amino acid sequences of SEQ ID NO 2701 to 2725 and 12279-12294 wherein up to 9 amino acid residues but no more than 10 amino acids are replaced by any other amino acid residues, or sequences with 80-100% identity to amino acid sequences of SEQ ID NO 2701 to 2725 and 12279-12294, or sequences with 98-100% identity in the three complementarity determining regions (CDR's) of SEQ ID NO 2701 to 2725 and 12279-12294. Table 5 shows the target antigens, names, SEQ ID NO (DNA) and SEQ ID NO (PRT) of the Exemplary vHH domains used in this disclosure.

In some embodiments, the encoded one or more antigen binding domains of the SIR polypeptide comprise any one or more of non immunoglobulin antigen binding scaffold amino acid sequences of SEQ ID NO: 2728 to 2732 and 12296-12301 wherein up to 9 amino acid residues but no more than 10 amino acids are replaced by any other amino acid residues, or sequences with 80-100% identity to amino acid sequences of SEQ ID NO: 2728 to 2732 and 12296-12301. Table 6A shows the target antigens, names, SEQ ID NO (DNA), SEQ ID NO (PRT), names of the exemplary non immunoglobulin antigen binding scaffold used in this disclosure.

In some embodiments, the encoded one or more antigen binding domains of the SIR polypeptide comprise any one or more of receptor amino acid sequences of SEQ ID NO 2736 to 2747 wherein up to 19 amino acid residues but no more than 20 amino acids are replaced by any other amino acid residues, or sequences with 80-100% identity to amino acid sequences of SEQ ID NO 2736 to 2747. Table 6A shows the target antigens, SEQ ID NO (DNA), SEQ ID NO (PRT), and names.

In some embodiments, the encoded one or more antigen binding domains of the SIR polypeptide comprise an autoantigen amino acid sequences of SEQ ID NO 2748 wherein up to 19 amino acid residues but no more than 20 amino acids are replaced by any other amino acid residues, or sequences with 80-100% identity to amino acid sequences of SEQ ID NO 2748. Table 6A shows the target antigens, SEQ ID NO (DNA), SEQ ID NO (PRT), and names.

In some embodiments, the encoded one or more antigen binding domains of the SIR molecule comprise any one or more of ligand amino acid sequences of SEQ ID NO 2758 to 2768 and 12359-12361 and 18918 wherein up to 19 amino acid residues but no more than 20 amino acids are replaced by any other amino acid residues or sequences with 80-100% identity to amino acid sequences of SEQ ID NO 2758 to 2768 and 12359-12361 and 18918. Table 6A shows the target antigens, SEQ ID NO (DNA), SEQ ID NO (PRT), and names.

In some embodiments, the encoded one or more antigen binding domains of the SIR polypeptide comprise any one or more of scFv amino acid sequences of SEQ ID NO 2770 to 2939, 12303-12357 and 18162-18224 wherein up to 18 amino acid residues but no more than 20 amino acids are replaced by any other amino acid residues, or sequences with 80-100% identity to amino acid sequences of SEQ ID NO 2770 to 2939, 12303-12357 and 18162-18224 or sequences with 98-100% identity in the six complementarity determining regions (CDR's) in each of SEQ ID NO 2770 to 2939, 12303-12357 and 18162-18224. Table 6B shows the target antigens, SEQ ID NO (DNA), SEQ ID NO (PRT), names and amino acid sequences of the exemplary scFVs used in this disclosure.

In some embodiments, the encoded one or more antigen binding domains of the SIR polypeptide comprise any one or more of an antigen binding portion, e.g., CDRs, of vL and vH fragments targeting this antigen. The SEQ ID NO of the CDR1-3 of the vL and vH fragments targeting different antigens are listed in Table 5.

In some embodiments, the encoded one or more antigen binding domains of the SIR polypeptide comprise any one or more of an antigen binding portion, e.g., CDRs, of vL and vH fragments of the scFv comprising the SIR polypeptide. The SEQ ID NO of the CDR1-3 of the vL and vH fragments comprising the scFv fragments targeting different antigens are listed in Table 5. The SEQ ID NO (DNA) and SEQ ID NO (PRT) of the scFv fragments targeting different antigens are listed in Table 6A and the sequences of their corresponding CDR1-3 can be determined by methods known in the art or from SEQ ID NOs of the CDR1-3 of their component vL and vH fragments that are listed in Table 5.

In some embodiments, the encoded one or more antigen binding domains of the SIR polypeptide comprise any one or more of an antigen binding portion, e.g., CDRs, of vHH fragments targeting this antigen. The SEQ ID NO of the vHH fragments targeting different antigens are listed in Table 5 and the sequences of their corresponding CDR1-3 can be determined by methods known in the art.

In one embodiment, an antigen binding domain of a SIR is an antigen binding portion of a receptor known to bind this target antigen.

In some embodiments, the encoded one or more antigen binding domains of the SIR polypeptide comprise any one or more of an antigen binding portion of the receptor comprising the SIR polypeptide.

In some embodiments, the encoded one or more antigen binding domains of the SIR polypeptide comprise any one or more of an antigen binding portion of the ligand comprising the SIR polypeptide.

In some embodiments, the encoded one or more antigen binding domains of the SIR polypeptide comprise any one or more of an antigen binding portion of the non-immunoglobulin scaffold comprising the SIR polypeptide.

In another embodiment, the disclosure provides SIRs that bind to the same epitope on the different targets described in Tables 7A-7H as any of the SIRs of the disclosure (i.e., SIRs that have the ability to cross-compete for binding to the different targets with any of the SIRs of the disclosure). In some embodiments, the antigen specific domains of these SIRs could be determined from vL fragments, vH fragments and/or scFv fragments of the antibodies that were used as the component of the SIR. In some embodiments, the reference antibodies for cross-competition studies to determine the target-epitope recognized by a SIR of the disclosure described in Tables 7A-7H are scFvs having sequences as shown in SEQ ID NOs: SEQ ID NO 2770 to 2939, 12303-12357 and 18162-18224 (Table 6B). In an exemplary embodiment, the reference scFv FMC63 represented by SEQ ID NO: 2770 can be used in cross-competition studies to determine the target-epitope recognized by FMC63-based SIRs of the disclosure described in Tables 7A-7H. In some embodiments, the reference vHH fragments for cross-competition studies to determine the target-epitope recognized by a SIR of the disclosure described in Tables 7A-7H are vHH fragments having sequences as shown in SEQ ID NOs: 2701 to 2725 and 12279-12294 (Table 5). In some embodiments, the reference non-immunoglobulin antigen binding scaffolds for cross-competition studies for cross-competition studies to determine the target-epitope recognized by a SIR of the disclosure described in Tables 7A-7H are non-immunoglobulin antigen binding scaffolds having sequences as shown in SEQ ID NOs: 2728 to 2732 and 12296-12301 (Table 6A). In some embodiments, the reference ligands for cross-competition studies to determine the target-epitope recognized by a SIR of the disclosure described in Tables 7A-7H are ligands having sequences as shown in SEQ ID NOs: 2758 to 2768 and 12359-12361 and 18918 (Table 6A). In some embodiments, the reference SIRs for cross-competition studies against SIRs targeting different targets are SIRs having sequences as shown in SEQ ID NOs: 3435-3634, 13184-13292, (Table 7D) and SEQ ID Nos: 3855-4051 and 13411-13526 (Table 7E).

In another embodiment, the reference scFvs for cross-competition studies to determine the target-epitopes recognized by the MPL-targeting SIRs of the disclosure (e.g., SEQ ID NOs: 3566-3562, 13259, and 13265-13266) are the corresponding scFvs listed in Table 6B (e.g., SEQ ID NOs: 2871-2878, 12318, 12326-12327). In one embodiment, the reference scFvs for cross-competition studies to determine the target-epitopes recognized by the MPL-targeting SIRs of the disclosure are represented by SEQ ID NOs: 2871-2874.

In another embodiment, the reference ligands for cross-competition studies to determine the target-epitopes recognized by the MPL-targeting SIRs of the disclosure are the corresponding ligands listed in Table 6A (e.g., SEQ ID NOs: 2758-2759).

In another embodiment, the reference SIRs for cross-competition studies to determine the target-epitopes recognized by the MPL-targeting SIRs of the disclosure are MPL-SIRs listed in Table 7D and 7E (e.g., SEQ ID NOs: 3566-3562, 13259, and 13265-13266).

In one embodiment, an MPL-targeting SIR of the disclosure binds to an MPL-epitope corresponding to or overlapping with the peptide sequence -PWQDGPK- (SEQ ID NO: 15784).

In another embodiment, the reference scFvs for cross-competition studies to determine the target-epitopes recognized by the CD19-targeting SIRs of the disclosure (e.g., SEQ ID NOs: 3645-3649, 13195-13203, 13249 and 13267) are the corresponding scFvs listed in Table 6B (e.g., SEQ ID NOs: 2770-2774, 12308, 12325, 18162-18170). In one embodiment, the reference scFvs for cross-competition studies to determine the target-epitopes recognized by the CD19-targeting SIRs of the disclosure are represented by SEQ ID NOs: 2771, 2772, 12308, and 18169.

In another embodiment, the reference SIRs for cross-competition studies to determine the target-epitopes recognized by the CD19-targeting SIRs of the disclosure are CD19-targeting SIRs listed in Tables 7A-7H (e.g., SEQ ID NOs: 3645-3649, 13195-13203, 13249 and 13267).

In another embodiment, the reference scFvs for cross-competition studies to determine the target-epitopes recognized by the CD20-targeting SIRs of the disclosure (e.g., SEQ ID NOs: 3456-3457, 13204-13213) are the corresponding scFvs listed in Table 6B (e.g., SEQ ID NO: 2787-2788, 18177-18187). In one embodiment, the reference scFvs for cross-competition studies to determine the target-epitopes recognized by the CD20-targeting SIRs of the disclosure are represented by SEQ ID NOs: 18182, 18185 and 2787.

In another embodiment, the reference SIRs for cross-competition studies to determine the target-epitopes recognized by the CD20-targeting SIRs of the disclosure are CD20-SIRs listed in Tables 7A-H (e.g., SEQ ID NO: 3456-3457, 13204-13213)

In the preferred embodiment, the CD20-targeting SIRs of the disclosure bind to the epitopes corresponding to one or more of the sequences -PAGIYAPI- (SEQ ID NO: 18902), -FLKMESLNFIRAHTP- (SEQ ID NO: 18903), -HFLKMESLNFIRAHTPY- (SEQ ID NO: 18904), -YNAEPANPSEKNSPSTQY- (SEQ ID NO: 18905), -YNAEPANPSEKNSPST-(SEQ ID NO: 18906) and -YNCEPANPSEKNSP- (SEQ ID NO: 18907).

In another embodiment, the reference scFvs for cross-competition studies to determine the target-epitopes recognized by the BCMA-targeting SIRs of the disclosure (e.g., SEQ ID NOs: 3446-3449, 3632-3634, 13277-13284) are the corresponding scFvs listed in Table 6B (e.g., SEQ ID NO: 2780-2783, 12337-12344, and 18174-18176). In one embodiment, the reference scFvs for cross-competition studies to determine the target-epitopes recognized by the BCMA-targeting SIRs of the disclosure are represented by SEQ ID NOs: 2780-2781, 18175-18176.

In another embodiment, the reference SIRs for cross-competition studies to determine the target-epitopes recognized by the BCMA-targeting SIRs of the disclosure are BCMA-SIRs listed in Tables 7A-H (e.g., SEQ ID NO: 3446-3449, 3632-3634, 13277-13284)

In the preferred embodiment, the BCMA-targeting SIRs of the disclosure bind to the epitopes corresponding to one or more of the sequences listed in SEQ ID NOs: 18908-18912.

In another embodiment, the reference scFvs for cross-competition studies to determine the target-epitopes recognized by the CD22-targeting SIRs of the disclosure (e.g., SEQ ID NOs: 3458-3460, 13241-13245, 13268) are the corresponding scFvs listed in Table 6B (e.g., SEQ ID NOs: 2789-2791, 12320-12324, 12330, 18188). In one embodiment, the reference scFvs for cross-competition studies to determine the target-epitopes recognized by the CD22-targeting SIRs of the disclosure are represented by SEQ ID NOs: 18188, 12330 and 12320.

In another embodiment, the reference SIRs for cross-competition studies to determine the target-epitopes recognized by the CD22-targeting SIRs of the disclosure are CD22-SIRs listed in Tables 7A-H (e.g., SEQ ID NO: 3458-3460, 13241-13245, 13268)

In another embodiment, the reference scFvs for cross-competition studies to determine the target-epitopes recognized by the CD123-targeting SIRs of the disclosure (e.g., SEQ ID NOs: 2929, 3470, 13184-13194) are the corresponding scFvs listed in Table 6B (e.g., SEQ ID NOs: 2801, 18196-18206). In one embodiment, the reference scFvs for cross-competition studies to determine the target-epitopes recognized by the CD123-targeting SIRs of the disclosure are represented by SEQ ID NOs: 2929, 18196, 18197, 18200, 18202 and 18205.

In another embodiment, the reference SIRs for cross-competition studies to determine the target-epitopes recognized by the CD123-targeting SIRs of the disclosure are CD123-SIRs listed in Tables 7A-H (e.g., SEQ ID NOs: 3470, 13184-13194).

In another embodiment, the reference scFvs for cross-competition studies to determine the target-epitopes recognized by the CD33-targeting SIRs of the disclosure (e.g., SEQ ID NOs: 3464-3465, 13214-13220) are the corresponding scFvs listed in Table 6B (e.g., SEQ ID NOs: 2795-2796, 18189-18194). In one embodiment, the reference scFvs for cross-competition studies to determine the target-epitopes recognized by the CD33-targeting SIRs of the disclosure are represented by SEQ ID NOs: 2795, 2796, and 18127.

In another embodiment, the reference SIRs for cross-competition studies to determine the target-epitopes recognized by the CD33-targeting SIRs of the disclosure are CD33-SIRs listed in Tables 7A-H (e.g., SEQ ID NO: 3464-3465, 13214-13220)

In another embodiment, the reference scFvs for cross-competition studies to determine the target-epitopes recognized by the CS1-targeting SIRs of the disclosure (e.g., SEQ ID NOs: 3487-3489, 13226-1323) are the corresponding scFvs listed in Table 6B (e.g., SEQ ID NOs: 2817-2819 and 18211-18216). In one embodiment, the reference scFvs for cross-competition studies to determine the target-epitopes recognized by the CS1-targeting SIRs of the disclosure are represented by SEQ ID NOs: 2818, 18212, 18213, 18215 and 18216.

In another embodiment, the reference SIRs for cross-competition studies to determine the target-epitopes recognized by the CS1-targeting SIRs of the disclosure are CS1-SIRs listed in Tables 7A-H (e.g., SEQ ID NO: 3487-3489, 13226-1323)

In another embodiment, the reference scFvs for cross-competition studies to determine the target-epitopes recognized by the CLL1-targeting SIRs of the disclosure (e.g., SEQ ID NOs: 3484-3485, 13222-13225) are the corresponding scFvs listed in Table 6B (e.g., SEQ ID NOs: 2814-2815, 18207-18210, 12345-12346).

In another embodiment, the reference SIRs for cross-competition studies to determine the target-epitopes recognized by the CLL1-targeting SIRs of the disclosure are CLL1-SIRs listed in Tables 7A-H (e.g., SEQ ID NO: 3484-3485, 13222-13225).

In another embodiment, the reference scFvs for cross-competition studies to determine the target-epitopes recognized by the Mesothelin-targeting SIRs of the disclosure (e.g., SEQ ID NOs: 3554, 13287-13288) are the corresponding scFvs listed in Table 6B (e.g., SEQ ID NOs: 2870, 12352-12353).

In another embodiment, the reference SIRs for cross-competition studies to determine the target-epitopes recognized by the Mesothelin-targeting SIRs of the disclosure are Mesothelin-SIRs listed in Tables 7A-H (e.g., SEQ ID NO: 3554, 13287-13288)

In another embodiment, the reference scFvs for cross-competition studies to determine the target-epitopes recognized by the BST1/CD157-targeting SIRs of the disclosure are the corresponding scFvs listed in Table 6B.

In another embodiment, the reference SIRs for cross-competition studies to determine the target-epitopes recognized by the BST1/CD157-targeting SIRs of the disclosure are BST1/CD157-SIRs listed in Tables 7A-H.

In another embodiment, the reference scFvs for cross-competition studies to determine the target-epitopes recognized by the DLL3-targeting SIRs of the disclosure are the corresponding scFvs listed in Table 6B.

In another embodiment, the reference SIRs for cross-competition studies to determine the target-epitopes recognized by the DLL3-targeting SIRs of the disclosure are DLL3-SIRs listed in Tables 7A-H.

In another embodiment, the reference scFvs for cross-competition studies to determine the target-epitopes recognized by the PTK7-targeting SIRs of the disclosure are the corresponding scFvs listed in Table 6B.

In another embodiment, the reference SIRs for cross-competition studies to determine the target-epitopes recognized by the PTK7-targeting SIRs of the disclosure are PTK7-SIRs listed in Tables 7A-H.

In another embodiment, the reference scFvs for cross-competition studies to determine the target-epitopes recognized by the IL13Ra2-targeting SIRs of the disclosure are the corresponding scFvs listed in Table 6B.

In another embodiment, the reference SIRs for cross-competition studies to determine the target-epitopes recognized by the IL13Ra2-targeting SIRs of the disclosure are IL13Ra2-SIRs listed in Tables 7A-H.

In another embodiment, the reference scFvs for cross-competition studies to determine the target-epitopes recognized by the ROR1-targeting SIRs of the disclosure are the corresponding scFvs listed in Table 6B.

In another embodiment, the reference SIRs for cross-competition studies to determine the target-epitopes recognized by the ROR1-targeting SIRs of the disclosure are ROR1-SIRs listed in Tables 7A-H.

In another embodiment, the reference scFvs for cross-competition studies to determine the target-epitopes recognized by the TCRgd-targeting SIRs of the disclosure is the corresponding scFv listed in Table 6B.

In another embodiment, the reference SIRs for cross-competition studies to determine the target-epitopes recognized by the TCRgd-targeting SIRs of the disclosure are TCRgd-SIRs listed in Tables 7A-H.

In another embodiment, the reference scFvs for cross-competition studies to determine the target-epitopes recognized by the TCRB1-targeting SIRs of the disclosure is the corresponding scFv listed in Table 6B.

In another embodiment, the reference SIRs for cross-competition studies to determine the target-epitopes recognized by the TCRB1-targeting SIRs of the disclosure are TCRB1-SIRs listed in Tables 7A-H.

In another embodiment, the reference scFvs for cross-competition studies to determine the target-epitopes recognized by the TCRB2-targeting SIRs of the disclosure is the corresponding scFv listed in Table 6B.

In another embodiment, the reference SIRs for cross-competition studies to determine the target-epitopes recognized by the TCRB2-targeting SIRs of the disclosure are TCRB2-SIRs listed in Tables 7A-H.

In some embodiment, the SIRs targeting gp100, MART, Tyrosinase, hTERT, MUC1, CMV-pp65, HTLV1-Tax, HIV1-gag, NY-ESO, WT1, AFP, HPV-16-E7, PR1 and Ras G12V bind to target peptides shown in Table 71 in complex with MHC class I (e.g., HLA-A201).

In one embodiment, the reference scFvs for cross-competition studies to determine the target-epitopes recognized by the AFP/MHC I-targeting SIRs of the disclosure are represented by SEQ ID NOs: 18171 and 18173.

In one embodiment, the reference scFvs for cross-competition studies to determine the target-epitopes recognized by the WT1/MHC I-targeting SIRs of the disclosure are represented by SEQ ID NOs: 2926-2928.

In one embodiment, the reference scFvs for cross-competition studies to determine the target-epitopes recognized by the ALK-targeting SIRs of the disclosure is represented by SEQ ID NO: 2777.

In one embodiment, the reference scFvs for cross-competition studies to determine the target-epitopes recognized by the B7H4-targeting SIRs of the disclosure are represented by SEQ ID NOs: 2934-2935.

In one embodiment, the reference scFvs for cross-competition studies to determine the target-epitopes recognized by the CD30-targeting SIRs of the disclosure are represented by SEQ ID NOs: 2792-2793.

In one embodiment, the reference scFv for cross-competition studies to determine the target-epitopes recognized by the CD138-targeting SIRs of the disclosure is represented by SEQ ID NO: 2802.

In one embodiment, the reference scFv for cross-competition studies to determine the target-epitopes recognized by the EGFRviii-targeting SIRs of the disclosure is represented by SEQ ID NO: 2826.

In one embodiment, the reference scFv for cross-competition studies to determine the target-epitopes recognized by the FR1 (Folate receptor 1)-targeting SIRs of the disclosure is represented by SEQ ID NO: 2833.

In another embodiment, the reference scFvs for cross-competition studies to determine the target-epitopes recognized by the TROP2-, LAMP1-, CDH19-, CDH17-, CD70-, CD79b-, CDH6, TSHR-, ALK-, WT1/MHC 1, NY-ESO-1/MHC I, HIV1 env gp-, NYBR1, Lym1, Lym2, TSLRP-, Folate Receptor alpha-, B7H4-, CD200R-, Igk-Light chain-, CD179a-, CD179b-, Cripto-, STEAP1-, hLiv1-, ILRAP-, Nectin-4-, gpA33-, PSCA-, PSMA-, Muc1/MHC I, GFRa4-, EGFRviii-, EGFR-, Her2-, CSF2RA-, CLEC5A-, GPRC5D, Tn-Muc1-, FLT3-, PR1/MHC I-, AFP/MHC I- and HPV16-E7/MHC I-targeting SIRs of the disclosure are the corresponding scFv listed in Table 6B.

In another embodiment, the reference SIRs for cross-competition studies to determine the target-epitopes recognized by the TROP2-, LAMP1-, CDH19-, CDH17-, CD7-, CD79b-, CDH6, TSHR-, ALK-, WT1/MHC 1, NY-ESO-1/MHC I, HIV1 envelop glycoprotein-, NYBR1, Lym1, Lym2, TSLRP-, Folate Receptor alpha-, B7H4-, CD200R-, Igk-Light chain-, CD179a-, CD179b-, Cripto-, STEAP1-, hLiv1-, ILRAP-, Nectin-4-, gpA33-, PSCA-, PSMA-, Muc1/MHC I, GFRa4-, EGFRviii-, EGFR-, Her2-, CSF2RA-, CLEC5A-, GPRC5D, Tn-Muc1-, FLT3-, PR1/MHC I-, AFP/MHC I- and HPV16-E7/MHC I-targeting SIRs of the disclosure are the corresponding-SIRs listed in Tables 7A-H.

TABLE 5

| TARGET | NAME of vL | SEQ ID vL (DNA) | SEQ ID vL (PRT) | SEQ ID-vL CDR1 | SEQ ID-vL CDR2 | SEQ ID-vL CDR3 |
|---|---|---|---|---|---|---|
| ALK | Alk-48-vL | 16 | 2307 | 13999 | 14293 | 14587 |
| ALK | Alk-58-vL | 17 | 2308 | 14000 | 14294 | 14588 |
| Amyloid | Amyloid-158-vL | 18 | 2309 | 14001 | 14295 | 14589 |
| BCMA | BCMA-ET-40-vL | 19 | 2310 | 14002 | 14296 | 14590 |
| BCMA | BCMA-ET-54-vL | 20 | 2311 | 14003 | 14297 | 14591 |
| BCMA | BCMA-huC12A3-vL | 21 | 2312 | 14004 | 14298 | 14592 |
| BCMA | BCMA-J6M0-vL | 22 | 2313 | 14005 | 14299 | 14593 |
| CCR4 | CCR4-humAb1567-vL | 23 | 2314 | 14006 | 14300 | 14594 |
| CD123 | CD123-CSL362-vL | 24 | 2315 | 14007 | 14301 | 14595 |
| CD138 | CD138-vL | 25 | 2316 | 14008 | 14302 | 14596 |
| CD179b | CD179b-vL | 26 | 2317 | 14009 | 14303 | 14597 |
| CD19 | CD19-4G7-vL | 27 | 2318 | 14010 | 14304 | 14598 |
| CD19 | CD19Bu12-vL | 28 | 2319 | 14011 | 14305 | 14599 |
| CD19 | CD19MM-vL | 29 | 2320 | 14012 | 14306 | 14600 |
| CD19 | FMC63-vL | 30 | 2321 | 14013 | 14307 | 14601 |
| CD19 | FMC63-[2]-vL | 31 | 2322 | 14014 | 14308 | 14602 |
| CD19 | FMC63-[3]-vL | 32 | 2323 | 14015 | 14309 | 14603 |
| CD19 | huFMC63-11-vL | 33 | 2324 | 14016 | 14310 | 14604 |
| CD20 | CD20-2F2-vL | 34 | 2325 | 14017 | 14311 | 14605 |

TABLE 5-continued

| | | | | | | |
|---|---|---|---|---|---|---|
| CD20 | CD20-GA101-vL | 35 | 2326 | 14018 | 14312 | 14606 |
| CD22 | CD22-h10F4-vL | 36 | 2327 | 14019 | 14313 | 14607 |
| CD22 | CD22-H22Rhov2ACDRKA-vL | 37 | 2328 | 14020 | 14314 | 14608 |
| CD22 | CD22m971-vL | 38 | 2329 | 14021 | 14315 | 14609 |
| CD276 | CD276-17-vL | 39 | 2330 | 14022 | 14316 | 14610 |
| CD30 | CD30-5F11-vL | 40 | 2331 | 14023 | 14317 | 14611 |
| CD30 | CD30-Ac10-vL | 41 | 2332 | 14024 | 14318 | 14612 |
| CD32 | CD32-Med9-vL | 42 | 2333 | 14025 | 14319 | 14613 |
| CD324 | CD324-hSC10-17-vL | 43 | 2334 | 14026 | 14320 | 14614 |
| CD324 | CD324-SC10-6-vL | 44 | 2335 | 14027 | 14321 | 14615 |
| CD33 | CD33-huMyc9-vL | 45 | 2336 | 14028 | 14322 | 14616 |
| CD33 | CD33-AF5-vL | 46 | 2337 | 14029 | 14323 | 14617 |
| CD34 | CD34-hu4C7-[2]-vL | 47 | 2338 | 14030 | 14324 | 14618 |
| CD34 | CD34-hu4C7-vL | 48 | 2339 | 14031 | 14325 | 14619 |
| CD44v6 | CD44v6-Biwa8-vL | 49 | 2340 | 14032 | 14326 | 14620 |
| CD5 | CD5-18-vL | 50 | 2341 | 14033 | 14327 | 14621 |
| CD5 | CD5-9-vL | 51 | 2342 | 14034 | 14328 | 14622 |
| CD70 | CD70-h1F6-vL | 52 | 2343 | 14035 | 14329 | 14623 |
| CD79b | CD79b-2F2-vL | 53 | 2344 | 14036 | 14330 | 14624 |
| CD79b | huMA79bv28-vL | 54 | 2345 | 14037 | 14331 | 14625 |
| CDH17 | CDH17-PTA001A4-vL | 55 | 2346 | 14038 | 14332 | 14626 |
| CDH19 | CDH19-16A4-vL | 56 | 2347 | 14039 | 14333 | 14627 |
| CDH6 | CDH6-NOV710-vL | 57 | 2348 | 14040 | 14334 | 14628 |
| CDH6 | CDH6-NOV712-vL | 58 | 2349 | 14041 | 14335 | 14629 |
| CLEC5A | CLEC5A-3E12A2-vL | 59 | 2350 | 14042 | 14336 | 14630 |
| CLEC5A | CLEC5A-8H8F5-vL | 60 | 2351 | 14043 | 14337 | 14631 |
| CLL1 | CLL1-M26-vL | 61 | 2352 | 14044 | 14338 | 14632 |
| CLL1 | CLL1-M32-vL | 62 | 2353 | 14045 | 14339 | 14633 |
| CMVpp65/MHC I | CMVpp65-F5-vL | 63 | 2354 | 14046 | 14340 | 14634 |
| CS1 | huLuc63-vL | 64 | 2355 | 14047 | 14341 | 14635 |
| CS1 | HuLuc64-[2]-vL | 65 | 2356 | 14048 | 14342 | 14636 |
| CS1 | HuLuc64-vL | 66 | 2357 | 14049 | 14343 | 14637 |
| CS1 | huLuc90-vL | 67 | 2358 | 14050 | 14344 | 14638 |
| CSF2RA | CSF2RA-Ab1-vL | 68 | 2359 | 14051 | 14345 | 14639 |
| CSF2RA | CSF2RA-Ab6-vL | 69 | 2360 | 14052 | 14346 | 14640 |
| DLL3 | DLL3-hSC16-13-vL | 70 | 2361 | 14053 | 14347 | 14641 |
| DLL3 | DLL3-hSC16-56-vL | 71 | 2362 | 14054 | 14348 | 14642 |
| EBNA3c/MHC I | EBNA3c-315-vL | 72 | 2363 | 14055 | 14349 | 14643 |
| EGFR | Cetuximab-vL | 73 | 2364 | 14056 | 14350 | 14644 |
| EGFR | Nimotuzumab-vL | 74 | 2365 | 14057 | 14351 | 14645 |
| EGFRviii | EGFRviii-139-vL | 75 | 2366 | 14058 | 14352 | 14646 |
| EGFRviii | EGFRviii-2173-vL | 76 | 2367 | 14059 | 14353 | 14647 |
| EpCam1 | EpCam1-D5K5-vL | 77 | 2368 | 14060 | 14354 | 14648 |
| EpCam1 | Epcam1-MM1-vL | 78 | 2369 | 14061 | 14355 | 14649 |
| FITC | FITC-vL | 79 | 2370 | 14062 | 14356 | 14650 |
| FLT3 | FLT3-NC7-vL | 80 | 2371 | 14063 | 14357 | 14651 |
| HIV1-envelop glycoprotein | HIV1-N6-vL | 81 | 2372 | 14064 | 14358 | 14652 |
| Folate Receptor 1 | FR1-huMov19-vL | 82 | 2373 | 14065 | 14359 | 14653 |
| GAD | GAD-G3H8-vL | 83 | 2374 | 14066 | 14360 | 14654 |
| GD2 | GD2-hu14-18-vL | 84 | 2375 | 14067 | 14361 | 14655 |
| GD2 | GD2-hu3F8-vL | 85 | 2376 | 14068 | 14362 | 14656 |
| GD3 | GD3-KM-641-vL | 86 | 2377 | 14069 | 14363 | 14657 |
| GFRa4 | GFRa4-P4-10-2-vL | 87 | 2378 | 14070 | 14364 | 14658 |

TABLE 5-continued

| | | | | | | |
|---|---|---|---|---|---|---|
| GFRa4 | GFRa4-P4-10-vL | 88 | 2379 | 14071 | 14365 | 14659 |
| GFRa4 | GFRAlpha4-P4-6-vL | 89 | 2380 | 14072 | 14366 | 14660 |
| FUCOSYL-GM1 | GM1-5B2-vL | 90 | 2381 | 14073 | 14367 | 14661 |
| FUCOSYL-GM1 | GM1-7E5-vL | 91 | 2382 | 14074 | 14368 | 14662 |
| gp100/MHC I | gp100-G2D12-vL | 92 | 2383 | 14075 | 14369 | 14663 |
| gp100/MHC I | gp100-vL | 93 | 2384 | 14076 | 14370 | 14664 |
| GPC3 | GPC3-4E5-vL | 94 | 2385 | 14077 | 14371 | 14665 |
| gpNMB | gpNMB-115-vL | 95 | 2386 | 14078 | 14372 | 14666 |
| GPRC5D | GPRC5D-ET150-18-vL | 96 | 2387 | 14079 | 14373 | 14667 |
| GPRC5D | GPRC5D-ET150-5-vL | 97 | 2388 | 14080 | 14374 | 14668 |
| Her2 | Her2-Hu4D5-vL | 98 | 2389 | 14081 | 14375 | 14669 |
| HIV1-gag (77-85)/MHC I | HIV1-E5-vL | 99 | 2390 | 14082 | 14376 | 14670 |
| HIV1-envelop glycoprotein | HIV1-3BNC117-vL | 100 | 2391 | 14083 | 14377 | 14671 |
| HIV1-envelop glycoprotein | HIV1-PGT-128-vL | 101 | 2392 | 14084 | 14378 | 14672 |
| HIV1-envelop glycoprotein | HIV1-VR-C01-vL | 102 | 2393 | 14085 | 14379 | 14673 |
| HIV1-envelop glycoprotein | HIV1-X5-vL | 103 | 2394 | 14086 | 14380 | 14674 |
| HMW-MAA | HMW-MAA-hIND-vL | 104 | 2395 | 14087 | 14381 | 14675 |
| HTLV1-TAX/MHC I | TAX-T3E3-vL | 105 | 2396 | 14088 | 14382 | 14676 |
| HTLV1-TAX/MHC I | TAX-T3F2-vL | 106 | 2397 | 14089 | 14383 | 14677 |
| IL11Ra | IL11Ra-8E2-vL | 107 | 2398 | 14090 | 14384 | 14678 |
| IL13Ra2 | IL13Ra2-hu107-vL | 108 | 2399 | 14091 | 14385 | 14679 |
| IL13Ra2 | IL13Ra2-Hu108-vL | 109 | 2400 | 14092 | 14386 | 14680 |
| IL6R | IL6R-M83-vL | 110 | 2401 | 14093 | 14387 | 14681 |
| Influenza A HA | FLU-MEDI-8852-vL | 111 | 2402 | 14094 | 14388 | 14682 |
| KSHV-gH | YC15-vL | 112 | 2403 | 14095 | 14389 | 14683 |
| KSHV-K8.1 | 4C3-vL | 113 | 2404 | 14096 | 14390 | 14684 |
| L1CAM | L1CAM-9-3-HU3-vL | 114 | 2405 | 14097 | 14391 | 14685 |
| LAMP1 | LAMP1-humab1-2-vL | 115 | 2406 | 14098 | 14392 | 14686 |
| LAMP1 | LAMP1-Mb4-vL | 116 | 2407 | 14099 | 14393 | 14687 |
| LewisY | LewisY-huS193-vL | 117 | 2408 | 14100 | 14394 | 14688 |
| Lym1 | Lym1-vL | 118 | 2409 | 14101 | 14395 | 14689 |
| Lym2 | Lym2-vL | 119 | 2410 | 14102 | 14396 | 14690 |
| MART1/MHC I | MART1-CAG10-vL | 120 | 2411 | 14103 | 14397 | 14691 |
| MART1/MHC I | MART1-CLA12-vL | 121 | 2412 | 14104 | 14398 | 14692 |
| Mesothelin | Mesothelin-m912-vL | 122 | 2413 | 14105 | 14399 | 14693 |
| MPL (TPO-R) | MPL-111-vL | 123 | 2414 | 14106 | 14400 | 14694 |
| MPL (TPO-R) | MPL-161-HL-vL | 124 | 2415 | 14107 | 14401 | 14695 |
| MPL (TPO-R) | MPL-161-vL | 125 | 2416 | 14108 | 14402 | 14696 |
| MPL (TPO-R) | MPL-175-vL | 126 | 2417 | 14109 | 14403 | 14697 |
| MPL (TPO-R) | MPL-178-vL | 127 | 2418 | 14110 | 14404 | 14698 |
| MPL (TPO-R) | MPL-huVB22Bw5-vL | 128 | 2419 | 14111 | 14405 | 14699 |
| MPL (TPO-R) | MPL-12E10-vL | 129 | 2420 | 14112 | 14406 | 14700 |

TABLE 5-continued

| | | | | | | |
|---|---|---|---|---|---|---|
| MPL (TPO-R) | MPL-AB317-vL | 130 | 2421 | 14113 | 14407 | 14701 |
| Muc1/MHC I | MUC1-D6-M3A1-vL | 131 | 2422 | 14114 | 14408 | 14702 |
| Muc1/MHC I | Muc1-D6-M3B8-vL | 132 | 2423 | 14115 | 14409 | 14703 |
| Muc16 | Muc16-4H11-vL | 133 | 2424 | 14116 | 14410 | 14704 |
| NKG2D | NKG2D-MS-vL | 134 | 2425 | 14117 | 14411 | 14705 |
| NYBR1 | NYBR1-vL | 135 | 2426 | 14118 | 14412 | 14706 |
| NY-ESO-1/MHC I | NY-ESO-T1-vL | 136 | 2427 | 14119 | 14413 | 14707 |
| PD1 | PD1-4H1-vL | 137 | 2428 | 14120 | 14414 | 14708 |
| PD1 | PD1-5C4-vL | 138 | 2429 | 14121 | 14415 | 14709 |
| PDL1 | PDL1-10A5-vL | 139 | 2430 | 14122 | 14416 | 14710 |
| PDL1 | PDL1-Atezoli-vL | 140 | 2431 | 14123 | 14417 | 14711 |
| PDL1 | PDL1-SP142-vL | 141 | 2432 | 14124 | 14418 | 14712 |
| PR1/MHC I | PR1-vL | 142 | 2433 | 14125 | 14419 | 14713 |
| PSCA | PSCA-Ha14-117-vL | 143 | 2434 | 14126 | 14420 | 14714 |
| PSCA | PSCA-Ha14-121-vL | 144 | 2435 | 14127 | 14421 | 14715 |
| PSMA | PSMA-006-vL | 145 | 2436 | 14128 | 14422 | 14716 |
| PSMA | PSMA-J591-vL | 146 | 2437 | 14129 | 14423 | 14717 |
| PTK7 | PTK7-hSC6-23-vL | 147 | 2438 | 14130 | 14424 | 14718 |
| PTK7 | PTK7-SC6-10-2-vL | 148 | 2439 | 14131 | 14425 | 14719 |
| ROR1 | ROR1-4A5-vL | 149 | 2440 | 14132 | 14426 | 14720 |
| ROR1 | ROR1-4C10-vL | 150 | 2441 | 14133 | 14427 | 14721 |
| SLea | SLea-5B1-vL | 151 | 2442 | 14134 | 14428 | 14722 |
| SLea | SLea-7E3-vL | 152 | 2443 | 14135 | 14429 | 14723 |
| SSEA4 | SSEA4-vL | 153 | 2444 | 14136 | 14430 | 14724 |
| TCRB1 | TCRB1-E09-vL | 154 | 2445 | 14137 | 14431 | 14725 |
| TCRB1 | TCRB1-Jovi1-vL | 155 | 2446 | 14138 | 14432 | 14726 |
| TCRB2 | TCRB2-CP01-D05-vL | 156 | 2447 | 14139 | 14433 | 14727 |
| TCRB2 | TCRB2-CP01-E05-vL | 157 | 2448 | 14140 | 14434 | 14728 |
| TCRgd | TCRgd-G5-4-vL | 158 | 2449 | 14141 | 14435 | 14729 |
| TERT/MHC I | TERT-3G3-T865-vL | 159 | 2450 | 14142 | 14436 | 14730 |
| TERT/MHC I | TERT-4A9-T540-vL | 160 | 2451 | 14143 | 14437 | 14731 |
| TGFBR2 | TGFBR2-Ab1-vL | 161 | 2452 | 14144 | 14438 | 14732 |
| TIM1 | TIM1-HVCR1-270-2-vL | 162 | 2453 | 14145 | 14439 | 14733 |
| TIM1 | Tim1HVCR1-ARD5-vL | 163 | 2454 | 14146 | 14440 | 14734 |
| TnAg | TnAg-vL | 164 | 2455 | 14147 | 14441 | 14735 |
| Tn-Muc1 | Tn-Muc1-hu5E5-vL | 165 | 2456 | 14148 | 14442 | 14736 |
| TROP2 | TROP2-ARA47-HV3KV3-vL | 166 | 2457 | 14149 | 14443 | 14737 |
| TROP2 | TROP2-h7E6-SVG-vL | 167 | 2458 | 14150 | 14444 | 14738 |
| TSHR | TSHR-5C9-vL | 168 | 2459 | 14151 | 14445 | 14739 |
| TSHR | TSHR-K1-70-vL | 169 | 2460 | 14152 | 14446 | 14740 |
| TSHR | TSHR-KB1-vL | 170 | 2461 | 14153 | 14447 | 14741 |
| TSLRP | TSLRP-vL | 171 | 2462 | 14154 | 14448 | 14742 |
| Tyrosinase/MHC I | Tyro-B2-vL | 172 | 2463 | 14155 | 14449 | 14743 |
| Tyrosinase/MHC I | Tyro-Mc1-vL | 173 | 2464 | 14156 | 14450 | 14744 |
| Tyrosinase/MHC I | TA2-vL | 174 | 2465 | 14157 | 14451 | 14745 |
| VEGFR3 | VEGFR3-Ab1-vL | 175 | 2466 | 14158 | 14452 | 14746 |
| WT1/MHC I | WT1-Ab13-vL | 176 | 2467 | 14159 | 14453 | 14747 |
| WT1/MHC I | WT1-Ab15-vL | 177 | 2468 | 14160 | 14454 | 14748 |
| WT1/MHC I | WT1-Ab1-vL | 178 | 2469 | 14161 | 14455 | 14749 |
| WT1/MHC I | WT1-Ab5-vL | 179 | 2470 | 14162 | 14456 | 14750 |
| EBV-gp350 | EBV-gp350-vL | 180 | 2471 | 14163 | 14457 | 14751 |
| CD123 | CD123-1172-vL | 181 | 2472 | 14164 | 14458 | 14752 |
| CDH19 | CDH19-4B10-vL | 182 | 2473 | 14165 | 14459 | 14753 |
| Folate Receptor Beta | FRbeta-m923-vL | 183 | 2474 | 14166 | 14460 | 14754 |
| LHR | LHR-8B7-vL | 184 | 2475 | 14167 | 14461 | 14755 |
| LHR | LHR-5F4-21-vL | 185 | 2476 | 14168 | 14462 | 14756 |

TABLE 5-continued

| | | | | | |
|---|---|---|---|---|---|
| B7H4 | B7H4-hu22Cl0-vL | 186 | 2477 | 14169 | 14463 | 14757 |
| B7H4 | B7H4-hu1D11-vL | 187 | 2478 | 14170 | 14464 | 14758 |
| IgE | IgE-omalizumab-vL | 188 | 2479 | 14171 | 14465 | 14759 |
| CD23 | CD23-p5E8-vL | 189 | 2480 | 14172 | 14466 | 14760 |
| GCC | GCC-5F9-vL | 190 | 2481 | 14173 | 14467 | 14761 |
| GCC | GCC-Ab229-vL | 191 | 2482 | 14174 | 14468 | 14762 |
| CD200R | CD200R-huDx182-vL | 10085 | 12042 | 14175 | 14469 | 14763 |
| AFP/MHC I | AFP-61-vL | 10086 | 12043 | 14176 | 14470 | 14764 |
| AFP/MHC I | AFP-76-vL | 10087 | 12044 | 14177 | 14471 | 14765 |
| AFP/MHC I | AFP-79-vL | 10088 | 12045 | 14178 | 14472 | 14766 |
| BCMA | BCMA-ET-03-vL | 10089 | 12046 | 14179 | 14473 | 14767 |
| BCMA | BCMA-huC11.D5.3L1H3-vL | 10090 | 12047 | 14180 | 14474 | 14768 |
| BCMA | BCMA-huC13-F12-vL | 10091 | 12048 | 14181 | 14475 | 14769 |
| CD123 | CD123-DART-1-vL | 10092 | 12049 | 14182 | 14476 | 14770 |
| CD123 | CD123-DART-2-vL | 10093 | 12050 | 14183 | 14477 | 14771 |
| CD123 | CD123-I3RB18-vL | 10094 | 12051 | 14184 | 14478 | 14772 |
| CD123 | CD123-hu3E3-vL | 10095 | 12052 | 14185 | 14479 | 14773 |
| CD123 | CD123-9F6-vL | 10096 | 12053 | 14186 | 14480 | 14774 |
| CD123 | CD123-I3RB2-vL | 10097 | 12054 | 14187 | 14481 | 14775 |
| CD123 | CD123-1176-vL | 10098 | 12055 | 14188 | 14482 | 14776 |
| CD123 | CD123-8B11-vL | 10099 | 12056 | 14189 | 14483 | 14777 |
| CD123 | CD123-2B8-vL | 10100 | 12057 | 14190 | 14484 | 14778 |
| CD123 | CD123-9D7-vL | 10101 | 12058 | 14191 | 14485 | 14779 |
| CD123 | CD123-3B10-vL | 10102 | 12059 | 14192 | 14486 | 14780 |
| CD19 | CD19-MEDI-3649-vL | 10103 | 12060 | 14193 | 14487 | 14781 |
| CD19 | CD19-Medrex-24D1-vL | 10104 | 12061 | 14194 | 14488 | 14782 |
| CD19 | CD19-MOR0028-vL | 10105 | 12062 | 14195 | 14489 | 14783 |
| CD19 | CD19-HD37-H2L1-vL | 10106 | 12063 | 14196 | 14490 | 14784 |
| CD19 | CD19-huBly3-vL | 10107 | 12064 | 14197 | 14491 | 14785 |
| CD19 | CD19-huSJ25C1-vL | 10108 | 12065 | 14198 | 14492 | 14786 |
| CD19 | CD19-hB4-vL | 10109 | 12066 | 14199 | 14493 | 14787 |
| CD19 | CD19-hu-mROO5-1-vL | 10110 | 12067 | 14200 | 14494 | 14788 |
| CD19 | CD19-hA19-vL | 10111 | 12068 | 14201 | 14495 | 14789 |
| CD20 | CD20-Leu16-vL | 10112 | 12069 | 14202 | 14496 | 14790 |
| CD20 | CD20-11B8-vL | 10113 | 12070 | 14203 | 14497 | 14791 |
| CD20 | CD20-2C6-vL | 10114 | 12071 | 14204 | 14498 | 14792 |
| CD20 | CD20-2H7-vL | 10115 | 12072 | 14205 | 14499 | 14793 |
| CD20 | CD20-hA20-vL | 10116 | 12073 | 14206 | 14500 | 14794 |
| CD20 | CD20-BM-CA-1925-v4-vL | 10117 | 12074 | 14207 | 14501 | 14795 |
| CD20 | CD20-Ubli-v4-vL | 10118 | 12075 | 14208 | 14502 | 14796 |
| CD20 | CD20-h1F5-vL | 10119 | 12076 | 14209 | 14503 | 14797 |
| CD20 | CD20-7D8-vL | 10120 | 12077 | 14210 | 14504 | 14798 |
| CD20 | CD20-AME-33-vL | 10121 | 12078 | 14211 | 14505 | 14799 |
| CD33 | CD33-Boehr2800308-vL | 10122 | 12079 | 14212 | 14506 | 14800 |
| CD33 | CD33-Him3-4-vL | 10123 | 12080 | 14213 | 14507 | 14801 |
| CD33 | CD33-SGNh2H12-vL | 10124 | 12081 | 14214 | 14508 | 14802 |
| CD33 | CD33-15G15-33-vL | 10125 | 12082 | 14215 | 14509 | 14803 |
| CD33 | CD33-33H4-vL | 10126 | 12083 | 14216 | 14510 | 14804 |
| CD33 | CD33-9C3-2-vL | 10127 | 12084 | 14217 | 14511 | 14805 |
| CD99 | CD99-hu12E7-vL | 10128 | 12085 | 14218 | 14512 | 14806 |
| CLL1 | CLL1-21C9-L2H3-vL | 10129 | 12086 | 14219 | 14513 | 14807 |

TABLE 5-continued

| | | | | | | |
|---|---|---|---|---|---|---|
| CLL1 | CLL1-6E7L4H1e-vL | 10130 | 12087 | 14220 | 14514 | 14808 |
| CLL1 | CLL1-hu1075-v1-vL | 10131 | 12088 | 14221 | 14515 | 14809 |
| CLL1 | CLL1-hu1075-v2-vL | 10132 | 12089 | 14222 | 14516 | 14810 |
| CS1 | CS1-PDL241-vL | 10133 | 12090 | 14223 | 14517 | 14811 |
| CS1 | CS1-Hu27A-vL | 10134 | 12091 | 14224 | 14518 | 14812 |
| CS1 | CS1-ScHu34C3-vL | 10135 | 12092 | 14225 | 14519 | 14813 |
| CS1 | CS1-Hu31-D2-vL | 10136 | 12093 | 14226 | 14520 | 14814 |
| CS1 | CS1-Luc34-vL | 10137 | 12094 | 14227 | 14521 | 14815 |
| CS1 | CS1-LucX2-vL | 10138 | 12095 | 14228 | 14522 | 14816 |
| FITC | FITC-4M-53-vL | 10139 | 12096 | 14229 | 14523 | 14817 |
| FITC | FITC-E2-vL | 10140 | 12097 | 14230 | 14524 | 14818 |
| GPRC5D | GPRC5D-ET150-1-vL | 10141 | 12098 | 14231 | 14525 | 14819 |
| GPRC5D | GPRC5D-ET150-2-vL | 10142 | 12099 | 14232 | 14526 | 14820 |
| HLA-A2 | HLA-A2-3PB2-vL | 10143 | 12100 | 14233 | 14527 | 14821 |
| HPV16-E7/MHC I | HPV16-7-8-vL | 10144 | 12101 | 14234 | 14528 | 14822 |
| HPV16-E7/MHC I | HPV16-2-vL | 10145 | 12102 | 14235 | 14529 | 14823 |
| Tissue Factor 1 (TF1) | TF1-98-vL | 10146 | 12103 | 14236 | 14530 | 14824 |
| Tn-Muc1 | Tn-Muc1-5E5-vL | 10147 | 12104 | 14237 | 14531 | 14825 |
| Igk-Light Chain | Kappa-LC1-vL | 10148 | 12105 | 14238 | 14532 | 14826 |
| PTK7 | PTK7-7C8-vL | 10149 | 12106 | 14239 | 14533 | 14827 |
| PTK7 | PTK7-12C6a-vL | 10150 | 12107 | 14240 | 14534 | 14828 |
| CD19 | hCD19-EUK5-13-vL | 10151 | 12108 | 14241 | 14535 | 14829 |
| Ras G12V/MHC I | Ras-Ab2-vL | 10152 | 12109 | 14242 | 14536 | 14830 |
| Ras G12V/MHC I | Ras-Ab4-vL | 10153 | 12110 | 14243 | 14537 | 14831 |
| CLD18A2 | CLD18A2-43A11-vL | 10154 | 12111 | 14244 | 14538 | 14832 |
| CLD18A2 | CLD18A2-175D10-vL | 10155 | 12112 | 14245 | 14539 | 14833 |
| CD43 | CD43-huJL-1-257-10-vL | 10156 | 12113 | 14246 | 14540 | 14834 |
| CD69L | CD69L-DREG200-vL | 10157 | 12114 | 14247 | 14541 | 14835 |
| NY-ESO-1/MHC I | NYESO-35-15-vL | 10158 | 12115 | 14248 | 14542 | 14836 |
| P-gp | Pgp-9F11-vL | 10159 | 12116 | 14249 | 14543 | 14837 |
| Streptag | Streptag-vL | 10160 | 12117 | 14250 | 14544 | 14838 |
| BCMA | BCMA-huC13-F12-L1H2-vL | 10161 | 12118 | 14251 | 14545 | 14839 |
| BCMA | BCMA-huC12A3-L3H3-vL | 10162 | 12119 | 14252 | 14546 | 14840 |
| MPL/TPO-R | Hu-161-2-vL | 10163 | 12120 | 14253 | 14547 | 14841 |
| P-gp | Pgp-MRK16-vL | 10164 | 12121 | 14254 | 14548 | 14842 |
| CD22 | CD22-5-vL | 10165 | 12122 | 14255 | 14549 | 14843 |
| CD22 | CD22-10-vL | 10166 | 12123 | 14256 | 14550 | 14844 |
| CD22 | CD22-31-vL | 10167 | 12124 | 14257 | 14551 | 14845 |
| CD22 | CD22-53-vL | 10168 | 12125 | 14258 | 14552 | 14846 |
| CD22 | CD22-65-vL | 10169 | 12126 | 14259 | 14553 | 14847 |
| CD19 | hu-FMC65-1-vL | 10170 | 12127 | 14260 | 14554 | 14848 |
| MPL/TPO-R | MPL-hu-175-2-vL | 10171 | 12128 | 14261 | 14555 | 14849 |
| MPL/TPO-R | MPL-hu-111-2-vL | 10172 | 12129 | 14262 | 14556 | 14850 |
| CD179a | CD179a-2460-B04-vL | 10173 | 12130 | 14263 | 14557 | 14851 |
| CD179a | CD179a-2462-E07-vL | 10174 | 12131 | 14264 | 14558 | 14852 |
| CD22 | CD22-HA22-vL | 10175 | 12132 | 14265 | 14559 | 14853 |
| STEAP1 | STEAP1-hu120-vL | 10176 | 12133 | 14266 | 14560 | 14854 |

TABLE 5-continued

| Target | Name | | | | |
|---|---|---|---|---|---|
| Liv1 | hLiv1-mAb2-vL | 10177 | 12134 | 14267 | 14561 | 14855 |
| Nectin-4 | hu-Nectin4-mAb1-vL | 10178 | 12135 | 14268 | 14562 | 14856 |
| Cripto | hu-Cripto-L1H2-vL | 10179 | 12136 | 14269 | 14563 | 14857 |
| gpA33 | hu-gpA33-vL | 10180 | 12137 | 14270 | 14564 | 14858 |
| ROR1 | ROR1-DART4-vL | 10181 | 12138 | 14271 | 14565 | 14859 |
| BCMA | BCMA-FS-vL | 10182 | 12139 | 14272 | 14566 | 14860 |
| BCMA | BCMA-PC-vL | 10183 | 12140 | 14273 | 14567 | 14861 |
| BCMA | BCMA-AJ-vL | 10184 | 12141 | 14274 | 14568 | 14862 |
| BCMA | BCMA-NM-vL | 10185 | 12142 | 14275 | 14569 | 14863 |
| BCMA | BCMA-TS-vL | 10186 | 12143 | 14276 | 14570 | 14864 |
| BCMA | BCMA-PP-vL | 10187 | 12144 | 14277 | 14571 | 14865 |
| BCMA | BCMA-RD-vL | 10188 | 12145 | 14278 | 14572 | 14866 |
| BCMA | BCMA-BB-CAR02-vL | 10189 | 12146 | 14279 | 14573 | 14867 |
| CLL1 | CLL1-24C8-vL | 10190 | 12147 | 14280 | 14574 | 14868 |
| CLL1 | CLL1-24C1-vL | 10191 | 12148 | 14281 | 14575 | 14869 |
| FLT3 | FLT3-10E3-vL | 10192 | 12149 | 14282 | 14576 | 14870 |
| FLT3 | FLT3-8B5-vL | 10193 | 12150 | 14283 | 14577 | 14871 |
| IL1RAP | IL1RAP-IAPB57-vL | 10194 | 12151 | 14284 | 14578 | 14872 |
| IL1RAP | IL1RAP-IAPB63-vL | 10195 | 12152 | 14285 | 14579 | 14873 |
| IL1RAP | hu-IL1RAP-CANO4-vL | 10196 | 12153 | 14286 | 14580 | 14874 |
| Mesothelin | MSLN-7D9-V3-vL | 10197 | 12154 | 14287 | 14581 | 14875 |
| Mesothelin | MSLN-hu22A10-vL | 10198 | 12155 | 14288 | 14582 | 14876 |
| CD19 | hu-Bu13-vL | 10199 | 12156 | 14289 | 14583 | 14877 |
| BST1/CD157 | hu-BST1-A1-vL | 10200 | 12157 | 14290 | 14584 | 14878 |
| BST1/CD157 | hu-BST1-A2-vL | 10201 | 12158 | 14291 | 14585 | 14879 |
| BST1/CD157 | hu-BST1-A3-vL | 10202 | 12159 | 14292 | 14586 | 14880 |
| CD20 | CD20-BM-CA-1925-v4-vL | 10117 | 12074 | 14207 | 14501 | 14795 |
| CD20 | CD20-Ubli-v4-vL | 10118 | 12075 | 14208 | 14502 | 14796 |
| CD20 | CD20-h1F5-vL | 10119 | 12076 | 14209 | 14503 | 14797 |
| CD20 | CD20-7D8-vL | 10120 | 12077 | 14210 | 14504 | 14798 |
| CD20 | CD20-AME-33-vL | 10121 | 12078 | 14211 | 14505 | 14799 |
| CD33 | CD33-Boehr2800308-vL | 10122 | 12079 | 14212 | 14506 | 14800 |
| CD33 | CD33-Him3-4-vL | 10123 | 12080 | 14213 | 14507 | 14801 |
| CD33 | CD33-SGNh2H12-vL | 10124 | 12081 | 14214 | 14508 | 14802 |
| CD33 | CD33-15G15-33-vL | 10125 | 12082 | 14215 | 14509 | 14803 |
| CD33 | CD33-33H4-vL | 10126 | 12083 | 14216 | 14510 | 14804 |
| CD33 | CD33-9C3-2-vL | 10127 | 12084 | 14217 | 14511 | 14805 |
| CD99 | CD99-hu12E7-vL | 10128 | 12085 | 14218 | 14512 | 14806 |
| CLL1 | CLL1-21C9-L2H3-vL | 10129 | 12086 | 14219 | 14513 | 14807 |
| CLL1 | CLL1-6E7L4H1e-vL | 10130 | 12087 | 14220 | 14514 | 14808 |
| CLL1 | CLL1-hu1075-v1-vL | 10131 | 12088 | 14221 | 14515 | 14809 |
| CLL1 | CLL1-hu1075-v2-vL | 10132 | 12089 | 14222 | 14516 | 14810 |
| CS1 | CS1-PDL241-vL | 10133 | 12090 | 14223 | 14517 | 14811 |
| CS1 | CS1-Hu27A-vL | 10134 | 12091 | 14224 | 14518 | 14812 |
| CS1 | CS1-ScHu34C3-vL | 10135 | 12092 | 14225 | 14519 | 14813 |
| CS1 | CS1-Hu31-D2-vL | 10136 | 12093 | 14226 | 14520 | 14814 |
| CS1 | CS1-Luc34-vL | 10137 | 12094 | 14227 | 14521 | 14815 |
| CS1 | CS1-LucX2-vL | 10138 | 12095 | 14228 | 14522 | 14816 |
| FITC | FITC-4M-53-vL | 10139 | 12096 | 14229 | 14523 | 14817 |
| FITC | FITC-E2-vL | 10140 | 12097 | 14230 | 14524 | 14818 |
| GPRC5D | GPRC5D-ET150-1-vL | 10141 | 12098 | 14231 | 14525 | 14819 |
| GPRC5D | GPRC5D-ET150-2-vL | 10142 | 12099 | 14232 | 14526 | 14820 |
| HLA-A2 | HLA-A2-3PB2-vL | 10143 | 12100 | 14233 | 14527 | 14821 |

TABLE 5-continued

| | | | | | | |
|---|---|---|---|---|---|---|
| HPV16-E7/MHC I | HPV16-7-8-vL | 10144 | 12101 | 14234 | 14528 | 14822 |
| HPV16-E7/MHC I | HPV16-2-vL | 10145 | 12102 | 14235 | 14529 | 14823 |
| Tissue Factor 1 (TF1) | TF1-98-vL | 10146 | 12103 | 14236 | 14530 | 14824 |
| Tn-Muc1 | Tn-Muc1-5E5-vL | 10147 | 12104 | 14237 | 14531 | 14825 |
| Igk-Light Chain | Kappa-LC1-vL | 10148 | 12105 | 14238 | 14532 | 14826 |
| PTK7 | PTK7-7C8-vL | 10149 | 12106 | 14239 | 14533 | 14827 |
| PTK7 | PTK7-12C6a-vL | 10150 | 12107 | 14240 | 14534 | 14828 |
| CD19 | hCD19-EUK5-13-vL | 10151 | 12108 | 14241 | 14535 | 14829 |
| Ras G12V/MHC I | Ras-Ab2-vL | 10152 | 12109 | 14242 | 14536 | 14830 |
| Ras G12V/MHC I | Ras-Ab4-vL | 10153 | 12110 | 14243 | 14537 | 14831 |
| CLD18A2 | CLD18A2-43A11-vL | 10154 | 12111 | 14244 | 14538 | 14832 |
| CLD18A2 | CLD18A2-175D10-vL | 10155 | 12112 | 14245 | 14539 | 14833 |
| CD43 | CD43-huJL-1-257-10-vL | 10156 | 12113 | 14246 | 14540 | 14834 |
| CD69L | CD69L-DREG200-vL | 10157 | 12114 | 14247 | 14541 | 14835 |
| NY-ESO-1/MHC I | NYESO-35-15-vL | 10158 | 12115 | 14248 | 14542 | 14836 |
| P-gp | Pgp-9F11-vL | 10159 | 12116 | 14249 | 14543 | 14837 |
| Streptag | Streptag-vL | 10160 | 12117 | 14250 | 14544 | 14838 |
| BCMA | BCMA-huC13-F12-L1H2-vL | 10161 | 12118 | 14251 | 14545 | 14839 |
| BCMA | BCMA-huC12A3-L3H3-vL | 10162 | 12119 | 14252 | 14546 | 14840 |
| MPL/TPO-R | Hu-161-2-vL | 10163 | 12120 | 14253 | 14547 | 14841 |
| P-gp | Pgp-MRK16-vL | 10164 | 12121 | 14254 | 14548 | 14842 |
| CD22 | CD22-5-vL | 10165 | 12122 | 14255 | 14549 | 14843 |
| CD22 | CD22-10-vL | 10166 | 12123 | 14256 | 14550 | 14844 |
| CD22 | CD22-31-vL | 10167 | 12124 | 14257 | 14551 | 14845 |
| CD22 | CD22-53-vL | 10168 | 12125 | 14258 | 14552 | 14846 |
| CD22 | CD22-65-vL | 10169 | 12126 | 14259 | 14553 | 14847 |
| CD19 | hu-FMC65-1-vL | 10170 | 12127 | 14260 | 14554 | 14848 |
| MPL/TPO-R | MPL-hu-175-2-vL | 10171 | 12128 | 14261 | 14555 | 14849 |
| MPL/TPO-R | MPL-hu-111-2-vL | 10172 | 12129 | 14262 | 14556 | 14850 |
| CD179a | CD179a-2460-B04-vL | 10173 | 12130 | 14263 | 14557 | 14851 |
| CD179a | CD179a-2462-E07-vL | 10174 | 12131 | 14264 | 14558 | 14852 |
| CD22 | CD22-HA22-vL | 10175 | 12132 | 14265 | 14559 | 14853 |
| STEAP1 | STEAP1-hu120-vL | 10176 | 12133 | 14266 | 14560 | 14854 |
| Liv1 | hLiv1-mAb2-vL | 10177 | 12134 | 14267 | 14561 | 14855 |
| Nectin-4 | hu-Nectin4-mAb1-vL | 10178 | 12135 | 14268 | 14562 | 14856 |
| Cripto | hu-Cripto-L1H2-vL | 10179 | 12136 | 14269 | 14563 | 14857 |
| gpA33 | hu-gpA33-vL | 10180 | 12137 | 14270 | 14564 | 14858 |
| ROR1 | ROR1-DART4-vL | 10181 | 12138 | 14271 | 14565 | 14859 |
| BCMA | BCMA-FS-vL | 10182 | 12139 | 14272 | 14566 | 14860 |
| BCMA | BCMA-PC-vL | 10183 | 12140 | 14273 | 14567 | 14861 |
| BCMA | BCMA-AJ-vL | 10184 | 12141 | 14274 | 14568 | 14862 |
| BCMA | BCMA-NM-vL | 10185 | 12142 | 14275 | 14569 | 14863 |
| BCMA | BCMA-TS-vL | 10186 | 12143 | 14276 | 14570 | 14864 |
| BCMA | BCMA-PP-vL | 10187 | 12144 | 14277 | 14571 | 14865 |
| BCMA | BCMA-RD-vL | 10188 | 12145 | 14278 | 14572 | 14866 |
| BCMA | BCMA-BB-CAR02-vL | 10189 | 12146 | 14279 | 14573 | 14867 |
| CLL1 | CLL1-24C8-vL | 10190 | 12147 | 14280 | 14574 | 14868 |
| CLL1 | CLL1-24C1-vL | 10191 | 12148 | 14281 | 14575 | 14869 |
| FLT3 | FLT3-10E3-vL | 10192 | 12149 | 14282 | 14576 | 14870 |
| FLT3 | FLT3-8B5-vL | 10193 | 12150 | 14283 | 14577 | 14871 |
| IL1RAP | IL1RAP-IAPB57-vL | 10194 | 12151 | 14284 | 14578 | 14872 |

TABLE 5-continued

| | | | | | | |
|---|---|---|---|---|---|---|
| IL1RAP | IL1RAP-IAPB63-vL | 10195 | 12152 | 14285 | 14579 | 14873 |
| IL1RAP | hu-IL1RAP-CANO4-vL | 10196 | 12153 | 14286 | 14580 | 14874 |
| Mesothelin | MSLN-7D9-V3-vL | 10197 | 12154 | 14287 | 14581 | 14875 |
| Mesothelin | MSLN-hu22A10-vL | 10198 | 12155 | 14288 | 14582 | 14876 |
| CD19 | hu-Bu13-vL | 10199 | 12156 | 14289 | 14583 | 14877 |
| BST1/CD157 | hu-BST1-A1-vL | 10200 | 12157 | 14290 | 14584 | 14878 |
| BST1/CD157 | hu-BST1-A2-vL | 10201 | 12158 | 14291 | 14585 | 14879 |
| BST1/CD157 | hu-BST1-A3-vL | 10202 | 12159 | 14292 | 14586 | 14880 |
| ALK | Alk-48-vH | 226 | 2506 | 14881 | 15175 | 15469 |
| ALK | Alk-58-vH | 227 | 2507 | 14882 | 15176 | 15470 |
| Amyloid | Amyloid-158-vH | 228 | 2508 | 14883 | 15177 | 15471 |
| BCMA | BCMA-ET-40-vH | 229 | 2509 | 14884 | 15178 | 15472 |
| BCMA | BCMA-ET-54-vH | 230 | 2510 | 14885 | 15179 | 15473 |
| BCMA | BCMA-huC12A3-vH | 231 | 2511 | 14886 | 15180 | 15474 |
| BCMA | BCMA-J6M0-vH | 232 | 2512 | 14887 | 15181 | 15475 |
| CCR4 | CCR4-humAb1567-vH | 233 | 2513 | 14888 | 15182 | 15476 |
| CD123 | CD123-CSL362-vH | 234 | 2514 | 14889 | 15183 | 15477 |
| CD138 | CD138-vH | 235 | 2515 | 14890 | 15184 | 15478 |
| CD179b | CD179b-vH | 236 | 2516 | 14891 | 15185 | 15479 |
| CD19 | CD19-4G7-vH | 237 | 2517 | 14892 | 15186 | 15480 |
| CD19 | CD19Bu12-vH | 238 | 2518 | 14893 | 15187 | 15481 |
| CD19 | CD19BU12-[2]-vH | 239 | 2519 | 14894 | 15188 | 15482 |
| CD19 | CD19MM-vH | 240 | 2520 | 14895 | 15189 | 15483 |
| CD19 | FMC63-vH | 241 | 2521 | 14896 | 15190 | 15484 |
| CD19 | FMC-63-vH | 242 | 2522 | 14897 | 15191 | 15485 |
| CD19 | huFMC63-11-vH | 243 | 2523 | 14898 | 15192 | 15486 |
| CD20 | CD20-2F2-vH | 244 | 2524 | 14899 | 15193 | 15487 |
| CD20 | CD20-GA101-vH | 245 | 2525 | 14900 | 15194 | 15488 |
| CD22 | CD22-h10F4-vH | 246 | 2526 | 14901 | 15195 | 15489 |
| CD22 | CD22-H22Rhov2ACDRKA-vH | 247 | 2527 | 14902 | 15196 | 15490 |
| CD22 | CD22m971-vH | 248 | 2528 | 14903 | 15197 | 15491 |
| CD276 | CD276-17-vH | 249 | 2529 | 14904 | 15198 | 15492 |
| CD30 | CD30-5F11-vH | 250 | 2530 | 14905 | 15199 | 15493 |
| CD30 | CD30-Ac10-vH | 251 | 2531 | 14906 | 15200 | 15494 |
| CD32 | CD32-Med9-vH | 252 | 2532 | 14907 | 15201 | 15495 |
| CD324 | CD324-hSC10-17-vH | 253 | 2533 | 14908 | 15202 | 15496 |
| CD324 | CD324-SC10-6-vH | 254 | 2534 | 14909 | 15203 | 15497 |
| CD33 | CD33-huMyc9-vH | 255 | 2535 | 14910 | 15204 | 15498 |
| CD33 | CD33-AF5-vH | 256 | 2536 | 14911 | 15205 | 15499 |
| CD34 | CD34-hu4C7-vH | 257 | 2537 | 14912 | 15206 | 15500 |
| CD44v6 | CD44v6-Biwa8-vH | 258 | 2538 | 14913 | 15207 | 15501 |
| CD5 | CD5-18-vH | 259 | 2539 | 14914 | 15208 | 15502 |
| CD5 | CD5-9-vH | 260 | 2540 | 14915 | 15209 | 15503 |
| CD70 | CD70-h1F6-vH | 261 | 2541 | 14916 | 15210 | 15504 |
| CD79b | CD79b-2F2-vH | 262 | 2542 | 14917 | 15211 | 15505 |
| CD79b | huMA79bv28-vH | 263 | 2543 | 14918 | 15212 | 15506 |
| CDH17 | CDH17-PTA001A4-vH | 264 | 2544 | 14919 | 15213 | 15507 |
| CDH19 | CDH19-16A4-vH | 265 | 2545 | 14920 | 15214 | 15508 |
| CDH6 | CDH6-NOV710-vH | 266 | 2546 | 14921 | 15215 | 15509 |
| CDH6 | CDH6-NOV712-vH | 267 | 2547 | 14922 | 15216 | 15510 |
| CLEC5A | CLEC5A-3E12A2-vH | 268 | 2548 | 14923 | 15217 | 15511 |
| CLEC5A | CLEC5A-8H8F5-vH | 269 | 2549 | 14924 | 15218 | 15512 |
| CLL1 | CLL1-M26-vH | 270 | 2550 | 14925 | 15219 | 15513 |
| CLL1 | CLL1-M32-vH | 271 | 2551 | 14926 | 15220 | 15514 |
| CMVpp65/MHC I | CMVpp65-F5-vH | 272 | 2552 | 14927 | 15221 | 15515 |
| CS1 | huLuc63-vH | 273 | 2553 | 14928 | 15222 | 15516 |
| CS1 | HuLuc64-vH | 274 | 2554 | 14929 | 15223 | 15517 |
| CS1 | huLuc90-vH | 275 | 2555 | 14930 | 15224 | 15518 |
| CSF2RA | CSF2RA-Ab1-vH | 276 | 2556 | 14931 | 15225 | 15519 |

TABLE 5-continued

| | | | | | | |
|---|---|---|---|---|---|---|
| CSF2RA | CSF2RA-Ab6-vH | 277 | 2557 | 14932 | 15226 | 15520 |
| DLL3 | DLL3-hSC16-13-vH | 278 | 2558 | 14933 | 15227 | 15521 |
| DLL3 | DLL3-hSC16-56-vH | 279 | 2559 | 14934 | 15228 | 15522 |
| EBNA3c/MHC I | EBNA3c-315-vH | 280 | 2560 | 14935 | 15229 | 15523 |
| EGFR | Cetuximab-vH | 281 | 2561 | 14936 | 15230 | 15524 |
| EGFR | Nimotuzumab-vH | 282 | 2562 | 14937 | 15231 | 15525 |
| EGFRviii | EGFRviii-139-vH | 283 | 2563 | 14938 | 15232 | 15526 |
| EGFRviii | EGFRviii-2173-vH | 284 | 2564 | 14939 | 15233 | 15527 |
| EpCam1 | EpCam1-D5K5-vH | 285 | 2565 | 14940 | 15234 | 15528 |
| EpCam1 | Epcam1-MM1-vH | 286 | 2566 | 14941 | 15235 | 15529 |
| FITC | FITC-vH | 287 | 2567 | 14942 | 15236 | 15530 |
| FLT3 | FLT3-NC7-vH | 288 | 2568 | 14943 | 15237 | 15531 |
| HIV1-envelop glycoprotein | HIV1-N6-vH | 289 | 2569 | 14944 | 15238 | 15532 |
| Folate Receptor 1 (FR1) | FR1-huMov19-vH | 290 | 2570 | 14945 | 15239 | 15533 |
| GAD | GAD-G3H8-vH | 291 | 2571 | 14946 | 15240 | 15534 |
| GD2 | GD2-hu14-18-vH | 292 | 2572 | 14947 | 15241 | 15535 |
| GD2 | GD2-hu3F8-vH | 293 | 2573 | 14948 | 15242 | 15536 |
| GD3 | GD3-KM-641-vH | 294 | 2574 | 14949 | 15243 | 15537 |
| GFRa4 | GFRa4-P4-10-vH | 295 | 2575 | 14950 | 15244 | 15538 |
| GFRa4 | GFRAlpha4-P4-6-vH | 296 | 2576 | 14951 | 15245 | 15539 |
| FUCOSYL-GM1 | GM1-5B2-vH | 297 | 2577 | 14952 | 15246 | 15540 |
| FUCOSYL-GM1 | GM1-7E5-vH | 298 | 2578 | 14953 | 15247 | 15541 |
| gp100/MHC I | gp100-G2D12-vH | 299 | 2579 | 14954 | 15248 | 15542 |
| gp100/MHC I | gp100-vH | 300 | 2580 | 14955 | 15249 | 15543 |
| GPC3 | GPC3-4E5-vH | 301 | 2581 | 14956 | 15250 | 15544 |
| gpNMB | gpNMB-115-vH | 302 | 2582 | 14957 | 15251 | 15545 |
| GPRC5D | GPRC5D-ET150-18-vH | 303 | 2583 | 14958 | 15252 | 15546 |
| GPRC5D | GPRC5D-ET150-5-vH | 304 | 2584 | 14959 | 15253 | 15547 |
| Her2 | Her2-Hu4D5-vH | 305 | 2585 | 14960 | 15254 | 15548 |
| HIV1-gag (77-85)/MHC | HIV1-E5-vH | 306 | 2586 | 14961 | 15255 | 15549 |
| HIV1-envelop glycoprotein | HIV1-3BNC117-vH | 307 | 2587 | 14962 | 15256 | 15550 |
| HIV1-envelop glycoprotein | HIV1-PGT-128-vH | 308 | 2588 | 14963 | 15257 | 15551 |
| HIV1-envelop glycoprotein | HIV1-VR-C01-vH | 309 | 2589 | 14964 | 15258 | 15552 |
| HIV1-envelop glycoprotein | HIV1-X5-vH | 310 | 2590 | 14965 | 15259 | 15553 |
| HMW-MAA | HMW-MAA-hIND-vH | 311 | 2591 | 14966 | 15260 | 15554 |
| HTLV1-TAX/MHC I | TAX-T3E3-vH | 312 | 2592 | 14967 | 15261 | 15555 |
| HTLV1-TAX/MHC I | TAX-T3F2-vH | 313 | 2593 | 14968 | 15262 | 15556 |
| IL11Ra | IL11Ra-8E2-vH | 314 | 2594 | 14969 | 15263 | 15557 |
| IL13Ra2 | IL13Ra2-hu107-vH | 315 | 2595 | 14970 | 15264 | 15558 |
| IL13Ra2 | IL13Ra2-Hu108-vH | 316 | 2596 | 14971 | 15265 | 15559 |
| IL6R | IL6R-M83-vH | 317 | 2597 | 14972 | 15266 | 15560 |
| Influenza A HA | FLU-MEDI-8852-vH | 318 | 2598 | 14973 | 15267 | 15561 |
| KSHV-gH | YC15-vH | 319 | 2599 | 14974 | 15268 | 15562 |
| KSHV-K8.1 | 4C3-vH | 320 | 2600 | 14975 | 15269 | 15563 |

TABLE 5-continued

| | | | | | | |
|---|---|---|---|---|---|---|
| L1CAM | L1CAM-9-3-HU3-vH | 321 | 2601 | 14976 | 15270 | 15564 |
| LAMP1 | LAMP1-humab1-2-vH | 322 | 2602 | 14977 | 15271 | 15565 |
| LAMP1 | LAMP1-Mb4-vH | 323 | 2603 | 14978 | 15272 | 15566 |
| LewisY | LewisY-huS193-vH | 324 | 2604 | 14979 | 15273 | 15567 |
| Lym1 | Lym1-vH | 325 | 2605 | 14980 | 15274 | 15568 |
| Lym2 | Lym2-vH | 326 | 2606 | 14981 | 15275 | 15569 |
| MART1/MHC I | MART1-CAG10-vH | 327 | 2607 | 14982 | 15276 | 15570 |
| MART1/MHC I | MART1-CLA12-vH | 328 | 2608 | 14983 | 15277 | 15571 |
| Mesothelin | Mesothelin-m912-[2]-vH | 329 | 2609 | 14984 | 15278 | 15572 |
| Mesothelin | Mesothelin-m912-vH | 330 | 2610 | 14985 | 15279 | 15573 |
| MPL (TPO-R) | MPL-111-vH | 331 | 2611 | 14986 | 15280 | 15574 |
| MPL (TPO-R) | MPL-161-HL-vH | 332 | 2612 | 14987 | 15281 | 15575 |
| MPL (TPO-R) | MPL-161-vH | 333 | 2613 | 14988 | 15282 | 15576 |
| MPL (TPO-R) | MPL-175-vH | 334 | 2614 | 14989 | 15283 | 15577 |
| MPL (TPO-R) | MPL-178-vH | 335 | 2615 | 14990 | 15284 | 15578 |
| MPL (TPO-R) | MPL-huVB22Bw5-vH | 336 | 2616 | 14991 | 15285 | 15579 |
| MPL (TPO-R) | MPL-12E10-vH | 337 | 2617 | 14992 | 15286 | 15580 |
| MPL (TPO-R) | MPL-AB317-vH | 338 | 2618 | 14993 | 15287 | 15581 |
| Muc1/MHC I | MUC1-D6-M3A1-vH | 339 | 2619 | 14994 | 15288 | 15582 |
| Muc1/MHC I | Muc1-D6-M3B8-vH | 340 | 2620 | 14995 | 15289 | 15583 |
| Muc16 | Muc16-4H11-vH | 341 | 2621 | 14996 | 15290 | 15584 |
| NKG2D | NKG2D-MS-vH | 342 | 2622 | 14997 | 15291 | 15585 |
| NYBR1 | NYBR1-vH | 343 | 2623 | 14998 | 15292 | 15586 |
| NY-ESO-1/MHC I | NY-ESO-T1-vH | 344 | 2624 | 14999 | 15293 | 15587 |
| NY-ESO-1/MHC I | NY-ESO-T2-vH | 345 | 2625 | 15000 | 15294 | 15588 |
| PD1 | PD1-4H1-vH | 346 | 2626 | 15001 | 15295 | 15589 |
| PD1 | PD1-5C4-vH | 347 | 2627 | 15002 | 15296 | 15590 |
| PDL1 | PDL1-Atezoli-vH | 348 | 2628 | 15003 | 15297 | 15591 |
| PDL1 | PDL1-SP142-vH | 349 | 2629 | 15004 | 15298 | 15592 |
| PR1/MHC I | PR1-vH | 350 | 2630 | 15005 | 15299 | 15593 |
| PSCA | PSCA-Ha14-117-vH | 351 | 2631 | 15006 | 15300 | 15594 |
| PSCA | PSCA-Ha14-121-vH | 352 | 2632 | 15007 | 15301 | 15595 |
| PSMA | PSMA-006-vH | 353 | 2633 | 15008 | 15302 | 15596 |
| PSMA | PSMA-J591-vH | 354 | 2634 | 15009 | 15303 | 15597 |
| PTK7 | PTK7-hSC6-23-vH | 355 | 2635 | 15010 | 15304 | 15598 |
| PTK7 | PTK7-SC6-10-2-vH | 356 | 2636 | 15011 | 15305 | 15599 |
| ROR1 | ROR1-4A5-vH | 357 | 2637 | 15012 | 15306 | 15600 |
| ROR1 | ROR1-4C10-vH | 358 | 2638 | 15013 | 15307 | 15601 |
| SLea | SLea-5B1-vH | 359 | 2639 | 15014 | 15308 | 15602 |
| SLea | SLea-7E3-vH | 360 | 2640 | 15015 | 15309 | 15603 |
| SSEA4 | SSEA4-vH | 361 | 2641 | 15016 | 15310 | 15604 |
| TCRB1 | TCRB1-E09-vH | 362 | 2642 | 15017 | 15311 | 15605 |
| TCRB1 | TCRB1-Jovi1-vH | 363 | 2643 | 15018 | 15312 | 15606 |
| TCRB2 | TCRB2-CP01-D05-vH | 364 | 2644 | 15019 | 15313 | 15607 |
| TCRB2 | TCRB2-CP01-E05-vH | 365 | 2645 | 15020 | 15314 | 15608 |
| TCRgd | TCRgd-G5-4-vH | 366 | 2646 | 15021 | 15315 | 15609 |
| TERT/MHC I | TERT-3G3-T865-vH | 367 | 2647 | 15022 | 15316 | 15610 |
| TERT/MHC I | TERT-4A9-T540-vH | 368 | 2648 | 15023 | 15317 | 15611 |
| TGFBR2 | TGFBR2-Ab1-vH | 369 | 2649 | 15024 | 15318 | 15612 |
| TIM1 | TIM1-HVCR1-270-2-vH | 370 | 2650 | 15025 | 15319 | 15613 |

TABLE 5-continued

| | | | | | |
|---|---|---|---|---|---|
| TIM1 | Tim1HVCR1-ARD5-vH | 371 | 2651 | 15026 | 15320 | 15614 |
| TnAg | TnAg-vH | 372 | 2652 | 15027 | 15321 | 15615 |
| Tn-Muc1 | Tn-Muc1-hu5E5-vH | 373 | 2653 | 15028 | 15322 | 15616 |
| TROP2 | TROP2-ARA47-HV3KV3-vH | 374 | 2654 | 15029 | 15323 | 15617 |
| TROP2 | TROP2-h7E6-SVG-vH | 375 | 2655 | 15030 | 15324 | 15618 |
| TSHR | TSHR-5C9-vH | 376 | 2656 | 15031 | 15325 | 15619 |
| TSHR | TSHR-K1-70-vH | 377 | 2657 | 15032 | 15326 | 15620 |
| TSHR | TSHR-KB1-vH | 378 | 2658 | 15033 | 15327 | 15621 |
| TSLRP | TSLRP-vH | 379 | 2659 | 15034 | 15328 | 15622 |
| Tyrosinase/MHC I | Tyro-B2-vH | 380 | 2660 | 15035 | 15329 | 15623 |
| Tyrosinase/MHC I | Tyro-Mc1-vH | 381 | 2661 | 15036 | 15330 | 15624 |
| Tyrosinase/MHC I | TA2-vH | 382 | 2662 | 15037 | 15331 | 15625 |
| VEGFR3 | VEGFR3-Ab1-vH | 383 | 2663 | 15038 | 15332 | 15626 |
| WT1/MHC I | WT1-Ab13-vH | 384 | 2664 | 15039 | 15333 | 15627 |
| WT1/MHC I | WT1-Ab15-vH | 385 | 2665 | 15040 | 15334 | 15628 |
| WT1/MHC I | WT1-Ab1-vH | 386 | 2666 | 15041 | 15335 | 15629 |
| WT1/MHC I | WT1-Ab5-[2]-vH | 387 | 2667 | 15042 | 15336 | 15630 |
| WT1/MHC I | WT1-Ab5-vH | 388 | 2668 | 15043 | 15337 | 15631 |
| EBV-gp350 | EBV-gp350-vH | 389 | 2669 | 15044 | 15338 | 15632 |
| CD123 | CD123-1172-vH | 390 | 2670 | 15045 | 15339 | 15633 |
| CDH19 | CDH19-4B10-vH | 391 | 2671 | 15046 | 15340 | 15634 |
| Folate Receptor Beta | FRbeta-m923-vH | 392 | 2672 | 15047 | 15341 | 15635 |
| LHR | LHR-8B7-vH | 393 | 2673 | 15048 | 15342 | 15636 |
| LHR | LHR-5F4-21-vH | 394 | 2674 | 15049 | 15343 | 15637 |
| B7H4 | B7H4-hu22Cl0-vH | 395 | 2675 | 15050 | 15344 | 15638 |
| B7H4 | B7H4-hu1D11-vH | 396 | 2676 | 15051 | 15345 | 15639 |
| IgE | IgE-omalizumab-vH | 397 | 2677 | 15052 | 15346 | 15640 |
| CD23 | CD23-p5E8-vH | 398 | 2678 | 15053 | 15347 | 15641 |
| GCC | GCC-5F9-vH | 399 | 2679 | 15054 | 15348 | 15642 |
| GCC | GCC-Ab229-vH | 400 | 2680 | 15055 | 15349 | 15643 |
| CD200R | CD200R-huDx182-vH | 10203 | 12160 | 15056 | 15350 | 15644 |
| AFP/MHC I | AFP-61-vH | 10204 | 12161 | 15057 | 15351 | 15645 |
| AFP/MHC I | AFP-76-vH | 10205 | 12162 | 15058 | 15352 | 15646 |
| AFP/MHC I | AFP-79-vH | 10206 | 12163 | 15059 | 15353 | 15647 |
| BCMA | BCMA-ET-03-vH | 10207 | 12164 | 15060 | 15354 | 15648 |
| BCMA | BCMA-huC11.D5.3L1H3-vH | 10208 | 12165 | 15061 | 15355 | 15649 |
| BCMA | BCMA-huC13-F12-vH | 10209 | 12166 | 15062 | 15356 | 15650 |
| CD123 | CD123-DART-1-vH | 10210 | 12167 | 15063 | 15357 | 15651 |
| CD123 | CD123-DART-2-vH | 10211 | 12168 | 15064 | 15358 | 15652 |
| CD123 | CD123-I3RB18-vH | 10212 | 12169 | 15065 | 15359 | 15653 |
| CD123 | CD123-hu3E3-vH | 10213 | 12170 | 15066 | 15360 | 15654 |
| CD123 | CD123-9F6-vH | 10214 | 12171 | 15067 | 15361 | 15655 |
| CD123 | CD123-I3RB2-vH | 10215 | 12172 | 15068 | 15362 | 15656 |
| CD123 | CD123-1176-vH | 10216 | 12173 | 15069 | 15363 | 15657 |
| CD123 | CD123-8B11-vH | 10217 | 12174 | 15070 | 15364 | 15658 |
| CD123 | CD123-2B8-vH | 10218 | 12175 | 15071 | 15365 | 15659 |
| CD123 | CD123-9D7-vH | 10219 | 12176 | 15072 | 15366 | 15660 |
| CD123 | CD123-3B10-vH | 10220 | 12177 | 15073 | 15367 | 15661 |
| CD19 | CD19-MEDI-3649-vH | 10221 | 12178 | 15074 | 15368 | 15662 |
| CD19 | CD19-Medrex-24D1-vH | 10222 | 12179 | 15075 | 15369 | 15663 |
| CD19 | CD19-MOR0028-vH | 10223 | 12180 | 15076 | 15370 | 15664 |
| CD19 | CD19-HD37-H2L1-vH | 10224 | 12181 | 15077 | 15371 | 15665 |
| CD19 | CD19-huBly3-vH | 10225 | 12182 | 15078 | 15372 | 15666 |

TABLE 5-continued

| | | | | | | |
|---|---|---|---|---|---|---|
| CD19 | CD19-huSJ25C1-vH | 10226 | 12183 | 15079 | 15373 | 15667 |
| CD19 | CD19-hB4-vH | 10227 | 12184 | 15080 | 15374 | 15668 |
| CD19 | CD19-hu-mROO5-1-vH | 10228 | 12185 | 15081 | 15375 | 15669 |
| CD19 | CD19-hA19-vH | 10229 | 12186 | 15082 | 15376 | 15670 |
| CD20 | CD20-Leu16-vH | 10230 | 12187 | 15083 | 15377 | 15671 |
| CD20 | CD20-11B8-vH | 10231 | 12188 | 15084 | 15378 | 15672 |
| CD20 | CD20-2C6-vH | 10232 | 12189 | 15085 | 15379 | 15673 |
| CD20 | CD20-2H7-vH | 10233 | 12190 | 15086 | 15380 | 15674 |
| CD20 | CD20-hA20-vH | 10234 | 12191 | 15087 | 15381 | 15675 |
| CD20 | CD20-BM-CA-1925-v4-vH | 10235 | 12192 | 15088 | 15382 | 15676 |
| CD20 | CD20-Ubli-v4-vH | 10236 | 12193 | 15089 | 15383 | 15677 |
| CD20 | CD20-h1F5-vH | 10237 | 12194 | 15090 | 15384 | 15678 |
| CD20 | CD20-7D8-vH | 10238 | 12195 | 15091 | 15385 | 15679 |
| CD20 | CD20-AME-33-vH | 10239 | 12196 | 15092 | 15386 | 15680 |
| CD33 | CD33-Boehr2800308-vH | 10240 | 12197 | 15093 | 15387 | 15681 |
| CD33 | CD33-Him3-4-vH | 10241 | 12198 | 15094 | 15388 | 15682 |
| CD33 | CD33-SGNh2H12-vH | 10242 | 12199 | 15095 | 15389 | 15683 |
| CD33 | CD33-15G15-33-vH | 10243 | 12200 | 15096 | 15390 | 15684 |
| CD33 | CD33-33H4-vH | 10244 | 12201 | 15097 | 15391 | 15685 |
| CD33 | CD33-33H4-2-vH | 10245 | 12202 | 15098 | 15392 | 15686 |
| CD33 | CD33-9C3-2-vH | 10246 | 12203 | 15099 | 15393 | 15687 |
| CD99 | CD99-hu12E7-vH | 10247 | 12204 | 15100 | 15394 | 15688 |
| CLL1 | CLL1-21C9-L2H3-vH | 10248 | 12205 | 15101 | 15395 | 15689 |
| CLL1 | CLL1-6E7L4H1e-vH | 10249 | 12206 | 15102 | 15396 | 15690 |
| CLL1 | CLL1-hu1075-v1-vH | 10250 | 12207 | 15103 | 15397 | 15691 |
| CLL1 | CLL1-hu1075-v2-vH | 10251 | 12208 | 15104 | 15398 | 15692 |
| CS1 | CS1-PDL241-vH | 10252 | 12209 | 15105 | 15399 | 15693 |
| CS1 | CS1-Hu27A-vH | 10253 | 12210 | 15106 | 15400 | 15694 |
| CS1 | CS1-ScHu34C3-vH | 10254 | 12211 | 15107 | 15401 | 15695 |
| CS1 | CS1-Hu31-D2-vH | 10255 | 12212 | 15108 | 15402 | 15696 |
| CS1 | CS1-Luc34-vH | 10256 | 12213 | 15109 | 15403 | 15697 |
| CS1 | CS1-LucX2-vH | 10257 | 12214 | 15110 | 15404 | 15698 |
| FITC | FITC-4M-53-vH | 10258 | 12215 | 15111 | 15405 | 15699 |
| FITC | FITC-E2-vH | 10259 | 12216 | 15112 | 15406 | 15700 |
| GPRC5D | GPRC5D-ET150-1-vH | 10260 | 12217 | 15113 | 15407 | 15701 |
| GPRC5D | GPRC5D-ET150-2-vH | 10261 | 12218 | 15114 | 15408 | 15702 |
| HLA-A2 | HLA-A2-3PB2-vH | 10262 | 12219 | 15115 | 15409 | 15703 |
| HPV16-E7/MHC I | HPV16-7-8-vH | 10263 | 12220 | 15116 | 15410 | 15704 |
| HPV16-E7/MHC I | HPV16-2-vH | 10264 | 12221 | 15117 | 15411 | 15705 |
| Tissue Factor 1 (TF1) | TF1-98-vH | 10265 | 12222 | 15118 | 15412 | 15706 |
| Tn-Muc1 | Tn-Muc1-5E5-vH | 10266 | 12223 | 15119 | 15413 | 15707 |
| Igk-Light Chain | Kappa-LC1-vH | 10267 | 12224 | 15120 | 15414 | 15708 |
| PTK7 | PTK7-7C8-vH | 10268 | 12225 | 15121 | 15415 | 15709 |
| PTK7 | PTK7-12C6a-vH | 10269 | 12226 | 15122 | 15416 | 15710 |
| CD19 | hCD19-EUK5-13-vH | 10270 | 12227 | 15123 | 15417 | 15711 |
| Ras-G12V/MHC I | Ras-Ab2-vH | 10271 | 12228 | 15124 | 15418 | 15712 |
| Ras-G12V/MHC I | Ras-Ab4-vH | 10272 | 12229 | 15125 | 15419 | 15713 |

TABLE 5-continued

| | | | | | |
|---|---|---|---|---|---|
| CLD18A2 | CLD18A2-43A11-vH | 10273 | 12230 | 15126 | 15420 | 15714 |
| CLD18A2 | CLD18A2-175D10-vH | 10274 | 12231 | 15127 | 15421 | 15715 |
| CD43 | CD43-huJL-1-257-10-vH | 10275 | 12232 | 15128 | 15422 | 15716 |
| CD69L | CD69L-DREG200-vH | 10276 | 12233 | 15129 | 15423 | 15717 |
| NY-ESO-1/MHC I | NYESO-35-15-vH | 10277 | 12234 | 15130 | 15424 | 15718 |
| P-gp | Pgp-9F11-vH | 10278 | 12235 | 15131 | 15425 | 15719 |
| Streptag | Streptag-vH | 10279 | 12236 | 15132 | 15426 | 15720 |
| BCMA | BCMA-huC13-F12-L1H2-V2-vH | 10280 | 12237 | 15133 | 15427 | 15721 |
| BCMA | BCMA-huC12A3-L3H3-v2-vH | 10281 | 12238 | 15134 | 15428 | 15722 |
| MPL/TPO-R | Hu-161-2-vH | 10282 | 12239 | 15135 | 15429 | 15723 |
| P-gp | Pgp-MRK16-vH | 10283 | 12240 | 15136 | 15430 | 15724 |
| CD22 | CD22-5-vH | 10284 | 12241 | 15137 | 15431 | 15725 |
| CD22 | CD22-10-vH | 10285 | 12242 | 15138 | 15432 | 15726 |
| CD22 | CD22-31-vH | 10286 | 12243 | 15139 | 15433 | 15727 |
| CD22 | CD22-53-vH | 10287 | 12244 | 15140 | 15434 | 15728 |
| CD22 | CD22-65-vH | 10288 | 12245 | 15141 | 15435 | 15729 |
| CD19 | hu-FMC65-1-vH | 10289 | 12246 | 15142 | 15436 | 15730 |
| MPL/TPO-R | MPL-hu-175-2-vH | 10290 | 12247 | 15143 | 15437 | 15731 |
| MPL/TPO-R | MPL-hu-111-2-vH | 10291 | 12248 | 15144 | 15438 | 15732 |
| CD179a | CD179a-2460-B04-vH | 10292 | 12249 | 15145 | 15439 | 15733 |
| CD179a | CD179a-2462-E07-vH | 10293 | 12250 | 15146 | 15440 | 15734 |
| CD22 | CD22-HA22-vH | 10294 | 12251 | 15147 | 15441 | 15735 |
| STEAP1 | STEAP1-hu120-vH | 10295 | 12252 | 15148 | 15442 | 15736 |
| Liv1 | hLiv1-mAb2-vH | 10296 | 12253 | 15149 | 15443 | 15737 |
| Nectin-4 | hu-Nectin4-mAb1-vH | 10297 | 12254 | 15150 | 15444 | 15738 |
| Cripto | hu-Cripto-L1H2-vH | 10298 | 12255 | 15151 | 15445 | 15739 |
| gpA33 | hu-gpA33-vH | 10299 | 12256 | 15152 | 15446 | 15740 |
| ROR1 | ROR1-DART4-vH | 10300 | 12257 | 15153 | 15447 | 15741 |
| BCMA | BCMA-FS-vH | 10301 | 12258 | 15154 | 15448 | 15742 |
| BCMA | BCMA-PC-vH | 10302 | 12259 | 15155 | 15449 | 15743 |
| BCMA | BCMA-AJ-vH | 10303 | 12260 | 15156 | 15450 | 15744 |
| BCMA | BCMA-NM-vH | 10304 | 12261 | 15157 | 15451 | 15745 |
| BCMA | BCMA-TS-vH | 10305 | 12262 | 15158 | 15452 | 15746 |
| BCMA | BCMA-PP-vH | 10306 | 12263 | 15159 | 15453 | 15747 |
| BCMA | BCMA-RD-vH | 10307 | 12264 | 15160 | 15454 | 15748 |
| BCMA | BCMA-BB-CAR02-vH | 10308 | 12265 | 15161 | 15455 | 15749 |
| CLL1 | CLL1-24C8-vH | 10309 | 12266 | 15162 | 15456 | 15750 |
| CLL1 | CLL1-24C1-vH | 10310 | 12267 | 15163 | 15457 | 15751 |
| FLT3 | FLT3-10E3-vH | 10311 | 12268 | 15164 | 15458 | 15752 |
| FLT3 | FLT3-8B5-vH | 10312 | 12269 | 15165 | 15459 | 15753 |
| IL1RAP | IL1RAP-IAPB57-vH | 10313 | 12270 | 15166 | 15460 | 15754 |
| IL1RAP | IL1RAP-IAPB63-vH | 10314 | 12271 | 15167 | 15461 | 15755 |
| IL1RAP | hu-IL1RAP-CANO4-vH | 10315 | 12272 | 15168 | 15462 | 15756 |
| Mesothelin | MSLN-7D9-V3-vH | 10316 | 12273 | 15169 | 15463 | 15757 |
| Mesothelin | MSLN-hu22A10-vH | 10317 | 12274 | 15170 | 15464 | 15758 |
| CD19 | hu-Bu13-vH | 10318 | 12275 | 15171 | 15465 | 15759 |
| BST1/CD157 | hu-BST1-A1-vH | 10319 | 12276 | 15172 | 15466 | 15760 |
| BST1/CD157 | hu-BST1-A2-vH | 10320 | 12277 | 15173 | 15467 | 15761 |
| BST1/CD157 | hu-BST1-A3-vH | 10321 | 12278 | 15174 | 15468 | 15762 |

Abbreviations used in the following: MSLN, Mesothelin; Alb, Albumin GS; Gly-Ser-Linker

| TARGET | SEQ ID (DNA) | SEQ ID (PRT) | Name |
|---|---|---|---|
| Her2 | 421 | 2701 | Her2-2D3-vHH |
| Her2 | 422 | 2702 | Her2-5F7-vHH |
| Her2 | 423 | 2703 | Her2-47D5-vHH |

TABLE 5-continued

| | | | |
|---|---|---|---|
| Her3 | 424 | 2704 | Her3-17B05So-vHH |
| Her3 | 425 | 2705 | Her3-21F06-vHH |
| CEA | 426 | 2706 | CEA1-vHH |
| CEA | 427 | 2707 | CEA5-vHH |
| EGFR | 428 | 2708 | EGFR1-vHH |
| EGFR | 429 | 2709 | EGFR33-vHH |
| cMet | 430 | 2710 | cMET-171-vHH |
| CXCR4 | 431 | 2711 | CXCR4-2-vHH |
| CXCR4 | 432 | 2712 | CXCR4-1-vHH |
| MSLN | 433 | 2713 | SD1-vHH |
| MSLN | 434 | 2714 | SD2-vHH |
| Albumin | 435 | 2715 | Alb8-vHH |
| CD123 | 436 | 2716 | CD123-1-vHH |
| CD123 | 437 | 2717 | CD123-2-vHH |
| IL6R | 438 | 2718 | IL6R-304-vHH |
| EGFR&CEA | 439 | 2719 | EGFR1-vHH-Gly-Ser-Linker-CEA1-vHH |
| EGFR&CEA | 440 | 2720 | EGFR33-vHH-Gly-Ser-Linker-CEA5-vHH |
| Her2 | 441 | 2721 | Her2-5F7-vHH-Gly-Ser-Linker-Her2-47D5-vHH |
| Her2 | 442 | 2722 | Her2-Hu4D5-vL-Gly-Ser-Linker-Her2-Hu4D5-vH |
| Her3&Her2 | 443 | 2723 | Her3-17B05So-vHH-Gly-Ser-Linker-Her2-2D3-vHH |
| cMet&Her3 | 444 | 2724 | cMET-171-vHH-Gly-Ser-Linker-Her3-21F06-vHH |
| MSLN | 445 | 2725 | SD1-vHH-Gly-Ser-Linker-SD2-vHH |
| BCMA | 10322 | 12279 | BCMA353-vHH |
| BCMA | 10323 | 12280 | BCMA917-vHH |
| CD38 | 10325 | 12282 | CD38-717-vHH |
| BCMA | 10326 | 12283 | BCMA-346-vHH |
| BCMA | 10328 | 12285 | BCMA348-vHH |
| CD38 | 10329 | 12286 | CD38-331-vHH |
| CD19 | 10331 | 12288 | CD19-vHH |
| CD20 | 10332 | 12289 | CD20-vHH |
| BCMA | 10334 | 12291 | BCMA948-vHH |
| BCMA | 10335 | 12292 | BCMA972-vHH |
| BCMA | 10324 | 12281 | BCMA353-vHH-GS-BCMA917-vHH |
| BCMA & CD38 | 10327 | 12284 | CD38-717-vHH-Ecoil-BCMA-346-vHH |
| BCMA&CD38 | 10330 | 12287 | BCMA-348-vHH-Ecoil-CD38-331-vHH |
| CD19&CD20 | 10333 | 12290 | CD19-vHH-GS-CD20-vHH |
| BCMA | 10336 | 12293 | BCMA-948-vHH-PG4SP-BCMA-972-vHH |
| BCMA | 10337 | 12294 | BCMA-948-vHH-PG4SP-BCMA972-vHH-Ecoilx4 |

TABLE 6A

| Target | SEQ ID DNA | SEQ ID PRT | NAME |
|---|---|---|---|
| Her2 | 448 | 2728 | Her2-DARPIN-1 |
| Her2 | 449 | 2729 | Her2-DARPIN-2 |
| Her3 | 450 | 2730 | Her3-affi |
| Her2 | 451 | 2731 | Her2-affi |
| EGFR | 452 | 2732 | EGFR-affi |
| PSMA | 10339 | 12296 | PSMA-centyrin1 |
| PSMA | 10340 | 12297 | PSMA-centyrin2 |
| PSMA | 10341 | 12298 | PSMA-centyrin3 |
| EGFR | 10342 | 12299 | EGFR-centyrin |
| cMET | 10343 | 12300 | cMET-centyrin |
| EGFR & cMET | 10344 | 12301 | EGFR-centyrin-Linker-cMET centyrin |
| CD19 antibody; CD19-CAR | 456 | 2736 | hCD19-Extracellular-Domain-minus-signal-peptide(61-867) |
| Thrombopoeitin (TPO); MPL-CAR | 457 | 2737 | hMPL-Extracellular-Domain with signal ptepide |
| PDL1 | 458 | 2738 | CD8-SP-PD1-opt-ECD |
| PDL1 | 459 | 2739 | PD1-opt-ECD minus signal peptide |
| PDL1 | 460 | 2740 | PD1-ECD-with-native-Signal-Peptide |
| CD80 & CD86 | 461 | 2741 | CTLA4-opt-ECD with signal peptide |
| NKG2D Ligand | 462 | 2742 | NKG2D-ECD-minus-signal-peptide |
| HIV1 envelop | 463 | 2743 | CD4-ECD with signal peptide |
| HIV1 envelop | 464 | 2744 | DC-SIGN-minus-signal-peptide |
| Immunoglobulin | 465 | 2745 | CD16A-V158-ECD-v1-minus-signal-peptide |
| Immunoglobulin | 466 | 2746 | CD16A-V158-ECD-v2-minus-signal-peptide |

TABLE 6A-continued

| Target | SEQ ID DNA | SEQ ID PRT | NAME |
|---|---|---|---|
| Bitoin | 467 | 2747 | dc-Avidin-minus signal peptide |
| Dsg3 Autoantibody | 468 | 2748 | Desmoglein-3 (Dsg3)-ECD |
| MPL | 476 | 2758 | hTPO (1-187) |
| MPL | 477 | 2759 | mTPO(1-187) |
| GR/LHR | 478 | 2760 | CGH-alpha-minus-Signal-Peptide |
| GR/LHR | 479 | 2761 | CGH-beta-with-Signal-Peptide |
| FSHR | 480 | 2762 | FSH-beta-minus-Signal-Peptide |
| LHR | 481 | 2763 | LH-beta-with-Signal-Peptide |
| TSHR | 482 | 2764 | TSH-beta-with-Signal-Peptide |
| GR/LHR | 483 | 2765 | SP-CGHb-Gly-Ser-Linker-CGHa |
| FSHR | 484 | 2766 | CD8SP-FSHb-Gly-Ser-Linker-CGHa |
| GR/LHR | 485 | 2767 | SP-LHb-Gly-Ser-Linker-CGHa |
| TSHR | 486 | 2768 | SP-TSHb-Gly-Ser-Linker-CGHa |
| Cl channel | 10402 | 12359 | CLTX |
| Cl channel | 10403 | 12360 | CLTX23 |
| Cl channel | 10404 | 12361 | CLTX-Gly-Ser-Linker-CLTX23 |
| BCMA | 18914 | 18918 | APRIL-CD8-stalk |

TABLE 6B

| Target | NAME | SEQ ID DNA | SEQ ID PRT | Target | NAME | SEQ ID DNA | SEQ ID PRT |
|---|---|---|---|---|---|---|---|
| CD19 | FMC63 | 488 | 2770 | CDH17 | CDH17-PTA001A4 | 527 | 2809 |
| CD19 | huFMC63-11 | 489 | 2771 | CDH19 | CDH19-16A4 | 528 | 2810 |
| CD19 | CD19BU12 | 490 | 2772 | EGFR | Cetuximab | 529 | 2811 |
| CD19 | CD19MM | 491 | 2773 | CLEC5A | CLEC5A-8H8F5 | 530 | 2812 |
| CD19 | CD19-4G7 | 492 | 2774 | CLEC5A | CLEC5A-3E12A2 | 531 | 2813 |
| HIV1-env | HIV1-N6 | 493 | 2775 | CLL1 | CLL1-M26 | 532 | 2814 |
| ALK | Alk-48 | 494 | 2776 | CLL1 | CLL1-M32 | 533 | 2815 |
| ALK | Alk-58 | 495 | 2777 | CMVpp65 | CMVpp65-F5 | 534 | 2816 |
| Amyloid | Amyloid-158 | 496 | 2778 | CS1 | CS1-huLuc63 | 535 | 2817 |
| CD45 | BC8-CD45 | 497 | 2779 | CS1 | CS1-HuLuc64 | 536 | 2818 |
| BCMA | BCMA-J6M0 | 498 | 2780 | CS1 | CS1-huLuc90 | 537 | 2819 |
| BCMA | BCMA-huC12A3-L3H3 | 499 | 2781 | CSF2RA | CSF2RA-Ab6 | 538 | 2820 |
| BCMA | BCMA-ET-40 | 500 | 2782 | CSF2RA | CSF2RA-Ab1 | 539 | 2821 |
| BCMA | BCMA-ET-54 | 501 | 2783 | DLL3 | DLL3-hSC16-13 | 540 | 2822 |
| CCR4 | CCR4-humAb1567 | 502 | 2784 | DLL3 | DLL3-hSC16-56 | 541 | 2823 |
| CD5 | CD5-9 | 503 | 2785 | EBNA3c | EBNA3c-315 | 542 | 2824 |
| CD5 | CD5-18 | 504 | 2786 | Ebv-gp350 | EBV-gp350 | 543 | 2825 |
| CD20 | CD20-2F2 | 505 | 2787 | EGFRviii | EGFRvIII-139 | 544 | 2826 |
| CD20 | CD20-GA101 | 506 | 2788 | EGFRviii | EGFRvIII-2173 | 545 | 2827 |
| CD22 | CD22-h10F4v2 | 507 | 2789 | EpCam1 | Epcam1-MM1 | 546 | 2828 |
| CD22 | CD22-H22Rhov2ACDRKA | 508 | 2790 | EpCam1 | Epcam1-D5K5 | 547 | 2829 |
| CD22 | CD22-m971 | 509 | 2791 | FLT3 | FLT3-NC7 | 548 | 2830 |
| CD30 | CD30-5F11 | 510 | 2792 | FITC | FITC | 549 | 2831 |
| CD30 | CD30-Ac10 | 511 | 2793 | Influenza A HA | FLU-MEDI-8852 | 550 | 2832 |
| CD32 | CD32-Med9 | 512 | 2794 | FR1 | FR1-huMov19 | 551 | 2833 |
| CD33 | CD33-AF5 | 513 | 2795 | GAD | GAD-G3H8 | 552 | 2834 |
| CD33 | CD33-huMyc9 | 514 | 2796 | GD2 | GD2-hu14-18 | 553 | 2835 |
| CD34 | CD34-hu4C7 | 515 | 2797 | GD2 | GD2-hu3F8 | 554 | 2836 |
| CD44v6 | CD44v6-Biwa8 | 516 | 2798 | GD3 | GD3-KM-641 | 555 | 2837 |
| CD70 | CD70-h1F6 | 517 | 2799 | GFRa4 | GFRAlpha 4-P4-6 | 556 | 2838 |
| CD79b | CD79b-2F2 | 518 | 2800 | GFRa4 | GFRa4-P4-10 | 557 | 2839 |
| CD123 | CD123-CSL362 | 519 | 2801 | FUCOSYL-GM1 | GM1-5B2 | 558 | 2840 |
| CD138 | CD138 | 520 | 2802 | FUCOSYL-GM1 | GM1-7E5 | 559 | 2841 |
| CD179b | CD179b | 521 | 2803 | GPRC5D | GPRC5D-ET150-5 | 560 | 2842 |
| CD276 | CD276-17 | 522 | 2804 | GPRC5D | GPRC5D-ET150-18 | 561 | 2843 |
| CD324 | CD324-SC10-6 | 523 | 2805 | gp100 | gp100 | 562 | 2844 |
| CD324 | CD324-hSC10-17 | 524 | 2806 | gp100 | gp100-G2D12 | 563 | 2845 |
| CDH6 | CDH6-NOV710 | 525 | 2807 | GPC3 | GPC3-4E5 | 564 | 2846 |
| CDH6 | CDH6-NOV712 | 526 | 2808 | gpNMB | gpNMB-115 | 565 | 2847 |
| GRP78 | GRP78-GC18 | 566 | 2848 | PDL1 | PDL1-SP142 | 606 | 2888 |
| HIV1-gag (77-85) | HIV1-E5 | 567 | 2849 | PDL1 | PDL1-10A5 | 607 | 2889 |
| HIV1-env | HIV1-3BNC117 | 568 | 2850 | PSCA | PSCA-Ha14-121 | 608 | 2890 |
| HIV1-env | HIV1-PGT-128 | 569 | 2851 | PSCA | PSCA-Ha14-117 | 609 | 2891 |
| HIV1-env | HIV1-VR-C01 | 570 | 2852 | PR1 | PR1 | 610 | 2892 |

TABLE 6B-continued

| Target | NAME | SEQ ID DNA | SEQ ID PRT | Target | NAME | SEQ ID DNA | SEQ ID PRT |
|---|---|---|---|---|---|---|---|
| HIV1-env | HIV1-X5 | 571 | 2853 | PSMA | PSMA-006 | 611 | 2893 |
| HMW-MAA | HMW-MAA-hIND | 572 | 2854 | PSMA | PSMA-J591 | 612 | 2894 |
| HTLV1-TAX | HTLV-TAX-T3F2 | 573 | 2855 | PTK7 | PTK7-hSC6-23 | 613 | 2895 |
| HTLV1-TAX | HTLV-TAX-T3E3 | 574 | 2856 | PTK7 | PTK7-SC6-10-2 | 614 | 2896 |
| IL11Ra | IL11Ra-8E2-Ts107 | 575 | 2857 | ROR1 | ROR1-4A5 | 615 | 2897 |
| IL13Ra2 | IL13Ra2-hu107 | 576 | 2858 | ROR1 | ROR1-4C10 | 616 | 2898 |
| IL13Ra2 | IL13Ra2-Hu108 | 577 | 2859 | Mesothelin | SD1-vHH-Linker-SD2-VHH | 617 | 2899 |
| KSHV-K8.1 | KSHV-4C3 | 578 | 2860 | SLea | SLea-7E3 | 618 | 2900 |
| LAMP1 | LAMP1-humab1-2 | 579 | 2861 | SLea | SLea-5Bl | 619 | 2901 |
| LAMP1 | LAMP1-Mb4 | 580 | 2862 | SSEA4 | SSEA4 | 620 | 2902 |
| LewisY | LewisY-huS193 | 581 | 2863 | TCRB1 | TCRB1-CP01-E09 | 621 | 2903 |
| L1CAM | L1CAM-9-3-HU3 | 582 | 2864 | TCRB1 | TCRB1-Jovi1 | 622 | 2904 |
| Lym1 | Lym1 | 583 | 2865 | TCRB2 | TCRB2-CP01-D05 | 623 | 2905 |
| Lym2 | Lym2 | 584 | 2866 | TCRB2 | TCRB2-CP01-E05 | 624 | 2906 |
| CD79b | huMA79bv28 | 585 | 2867 | TCRgd | TCRgd-G5-4 | 625 | 2907 |
| MART1 | MART1-CAG10 | 586 | 2868 | TERT | TERT-4A9-T540 | 626 | 2908 |
| MART1 | MART1-CLA12 | 587 | 2869 | TERT | TERT-3G3-T865 | 627 | 2909 |
| Mesothelin | Mesothelin-m912 | 588 | 2870 | TGFBR2 | TGFBR2-Ab1 | 628 | 2910 |
| MPL | MPL-175 | 589 | 2871 | TIM1 | TIM1-HVCR1-270-2 | 629 | 2911 |
| MPL | MPL-161 | 590 | 2872 | TIM1 | TIM1-HVCR1-ARD5 | 630 | 2912 |
| MPL | MPL-161-HL | 591 | 2873 | TnAg | TnAg | 631 | 2913 |
| MPL | MPL-111 | 592 | 2874 | Tn-Muc1 | TnMuc1-hu5E5-RHA8-RKA-2 | 632 | 2914 |
| MPL | MPL-178 | 593 | 2875 | TROP2 | TROP2-ARA47-HV3KV3 | 633 | 2915 |
| MPL | MPL-AB317 | 594 | 2876 | TROP2 | TROP2-h7E6-SVG | 634 | 2916 |
| MPL | MPL-12E10 | 595 | 2877 | TSHR | TSHR-K1-70 | 635 | 2917 |
| MPL | MPL-huVB22Bw5 | 596 | 2878 | TSHR | TSHR-KB1 | 636 | 2918 |
| Muc1 | Muc1-D6-M3B8 | 597 | 2879 | TSHR | TSHR-5C9 | 637 | 2919 |
| Muc1 | MUC1-D6-M3A1 | 598 | 2880 | TSLRP | TSLRP | 638 | 2920 |
| Muc16 | Muc16-4H11 | 599 | 2881 | Tyrosinase | Tyros-B2 | 639 | 2921 |
| EGFR | Nimotuzumab | 600 | 2882 | Tyrosinase | Tyros-MC1 | 640 | 2922 |
| NKG2D | NKG2D-MS | 601 | 2883 | Tyrosinase | Tyros-TA2 | 641 | 2923 |
| NYBR1 | NYBR1 | 602 | 2884 | VEGFR3 | VEGFR3-Ab1 | 642 | 2924 |
| NYESO1 | NYESO-T1 | 603 | 2885 | WT1 | WT1-Ab1 | 643 | 2925 |
| NYESO1 | NYESO-T1 | 604 | 2886 | WT1 | WT1-Ab5 | 644 | 2926 |
| PDL1 | PDL1-Atezoli | 605 | 2887 | WT1 | WT1-Ab13 | 645 | 2927 |
| WT1 | WT1-Ab15 | 646 | 2928 | CD22 | CD22-65 | 10367 | 12324 |
| CD123 | CD123-1172 | 647 | 2929 | CD19 | hu-FMC65 | 10368 | 12325 |
| CDH19 | CDH19-4B10 | 648 | 2930 | MPL | MPL-hu-175-2 | 10369 | 12326 |
| FRbeta | FRbeta-m923 | 649 | 2931 | MPL | MPL-hu-111-2 | 10370 | 12327 |
| LHR-8B7 | LHR-8B7 | 650 | 2932 | CD179a | CD179a-2460-B04 | 10371 | 12328 |
| LHR | LHR-5F4-21 | 651 | 2933 | CD179a | CD179a-2462-E07 | 10372 | 12329 |
| B7H4 | B7H4-hu22Cl0 | 652 | 2934 | CD22 | CD22-HA22 | 10373 | 12330 |
| B7H4 | B7H4-hu1D11 | 653 | 2935 | STEAP1 | STEAP1-hu120 | 10374 | 12331 |
| IgE | IgE-omalizumab | 654 | 2936 | hLiv1 | hLiv1-mAb2 | 10375 | 12332 |
| CD23 | CD23-p5E8 | 655 | 2937 | Nectin-4 | hu-Nectin4-mAb1 | 10376 | 12333 |
| GCC | GCC-5F9 | 656 | 2938 | Cripto | hu-Cripto-L1H2 | 10377 | 12334 |
| GCC | GCC-Ab229 | 657 | 2939 | gpA33 | hu-gpA33 | 10378 | 12335 |
| CD200R | CD200R-huDx182 | 10346 | 12303 | ROR1 | ROR1-DART4 | 10379 | 12336 |
| Tn-Muc1-5E5 | Tn-Muc1-5E5 | 10347 | 12304 | BCMA | BCMA-FS-HL | 10380 | 12337 |
| Igk-Light Chain | Kappa-LC1 | 10348 | 12305 | BCMA | BCMA-PS-HL | 10381 | 12338 |
| PTK7 | PTK7-7C8 | 10349 | 12306 | BCMA | BCMA-AJ-HL | 10382 | 12339 |
| PTK7 | PTK7-12C6a | 10350 | 12307 | BCMA | BCMA-NM-HL | 10383 | 12340 |
| CD19 | hCD19-EUK5-13 | 10351 | 12308 | BCMA | BCMA-TS-HL | 10384 | 12341 |
| Ras-G12V | Ras-Ab2 | 10352 | 12309 | BCMA | BCMA-PP-HL | 10385 | 12342 |
| Ras-G12V | Ras-Ab4 | 10353 | 12310 | BCMA | BCMA-RD-HL | 10386 | 12343 |
| CLD18A2 | CLD18A2-43A11 | 10354 | 12311 | BCMA | BCMA-BB-CAR02-HL | 10387 | 12344 |
| CLD18A2 | CLD18A2-175D10 | 10355 | 12312 | CLL1 | CLL1-24C8-HL | 10388 | 12345 |
| CD43 | CD43-huJL-1-257-10 | 10356 | 12313 | CLL1 | CLL1-24C1-HL | 10389 | 12346 |
| CD69L | CD69L-DREG200 | 10357 | 12314 | FLT3 | FLT3-10E3-HL | 10390 | 12347 |
| NYESO1 | NYESO-35-15 | 10358 | 12315 | FLT3 | FLT3-8B5-HL | 10391 | 12348 |
| Pgp | Pgp-9F11 | 10359 | 12316 | IL1RAP | IL1RAP-IAPB57 | 10392 | 12349 |
| Streptag | Streptag | 10360 | 12317 | IL1RAP | IL1RAP-IAPB63 | 10393 | 12350 |
| MPL | Hu-161-2 | 10361 | 12318 | IL1RAP | hu-IL1RAP-CANO4 | 10394 | 12351 |
| Pgp | Pgp-MRK16 | 10362 | 12319 | Mesothelin | MSLN-7D9-v3-HL | 10395 | 12352 |
| CD22 | CD22-5 | 10363 | 12320 | Mesothelin | MSLN-hu22A10 | 10396 | 12353 |
| CD22 | CD22-10 | 10364 | 12321 | CD19 | hu-Bu13 | 10397 | 12354 |
| CD22 | CD22-31 | 10365 | 12322 | BST1CD157 | hu-BST1-A1 | 10398 | 12355 |
| CD22 | CD22-53 | 10366 | 12323 | BST1CD157 | hu-BST1-A2 | 10399 | 12356 |
| BST1CD157 | hu-BST1-A3 | 10400 | 12357 | CD33 | CD33-33H4 | 18129 | 18193 |

TABLE 6B-continued

| Target | NAME | SEQ ID DNA | SEQ ID PRT | Target | NAME | SEQ ID DNA | SEQ ID PRT |
|---|---|---|---|---|---|---|---|
| CD19 | CD19-MEDI-3649 | 18098 | 18162 | CD33 | CD33-9C3-2 | 18130 | 18194 |
| CD19 | CD19-Medrex-24D1 | 18099 | 18163 | CD99 | CD99-hu12E7 | 18131 | 18195 |
| CD19 | CD8SP-Ritx-CD19-MOR0028 | 18100 | 18164 | CD123 | CD123-DART1-1 | 18132 | 18196 |
| CD19 | CD19-HD37-H2L1 | 18101 | 18165 | CD123 | CD123-DART1-2 | 18133 | 18197 |
| CD19 | CD19-huBly3 | 18102 | 18166 | CD123 | CD123-I3RB18 | 18134 | 18198 |
| CD19 | CD19-huSJ25C1 | 18103 | 18167 | CD123 | CD123-hu3E3 | 18135 | 18199 |
| CD19 | CD8SP-Ritx-CD19-hB4 | 18104 | 18168 | CD123 | CD123-9F6 | 18136 | 18200 |
| CD19 | CD19-hu-mROO5-1 | 18105 | 18169 | CD123 | CD123-I3RB2 | 18137 | 18201 |
| CD19 | CD19-hA19 | 18106 | 18170 | CD123 | CD123-1176 | 18138 | 18202 |
| AFP | AFP-61 | 18107 | 18171 | CD123 | CD8SP-Ritx2-CD123-8B11 | 18139 | 18203 |
| AFP | AFP-76 | 18108 | 18172 | CD123 | CD123-2B8 | 18140 | 18204 |
| AFP | AFP-79 | 18109 | 18173 | CD123 | CD123-9D7 | 18141 | 18205 |
| BCMA | BCMA-ET-03 | 18110 | 18174 | CD123 | CD123-3B10 | 18142 | 18206 |
| BCMA | BCMA-huC11.D5.3L1H3 | 18111 | 18175 | CLL1 | CLL1-21C9-L2H3 | 18143 | 18207 |
| BCMA | BCMA-huC13-F12 | 18112 | 18176 | CLL1 | CLL1-6E7L4H1e | 18144 | 18208 |
| CD20 | CD20-11B8 | 18113 | 18177 | CLL1 | CLL1-hu1075-v1 | 18145 | 18209 |
| CD20 | CD20-2C6 | 18114 | 18178 | CLL1 | CLL1-hu1075-v2 | 18146 | 18210 |
| CD20 | CD20-2H7 | 18115 | 18179 | CS1 | CS1-PDL241 | 18147 | 18211 |
| CD20 | CD20-hA20 | 18116 | 18180 | CS1 | CS1-Hu27A | 18148 | 18212 |
| CD20 | CD20-BM-CA-1925-v4 | 18117 | 18181 | CS1 | CS1-ScHu34C3 | 18149 | 18213 |
| CD20 | CD20-Ubli-v4 | 18118 | 18182 | CS1 | CS1-Hu31-D2 | 18150 | 18214 |
| CD20 | CD20-2H7 | 18119 | 18183 | CS1 | CS1-Luc34 | 18151 | 18215 |
| CD20 | CD20-h1F5 | 18120 | 18184 | CS1 | CS1-LucX2 | 18152 | 18216 |
| CD20 | CD20-7D8 | 18121 | 18185 | FITC | FITC-4M-53 | 18153 | 18217 |
| CD20 | CD20-7D8-GA-tag | 18122 | 18186 | FITC | FITC-E2-HL | 18154 | 18218 |
| CD20 | CD20-AME-33 | 18123 | 18187 | GPRC5D | GPRC5D-ET150-1 | 18155 | 18219 |
| CD22 | CD22-m971-HL | 18124 | 18188 | GPRC5D | GPRC5D-ET150-2 | 18156 | 18220 |
| CD33 | CD8SP-Ritx2-BC33-Boehr2800308 | 18125 | 18189 | HLA-A2 | HLA-A2-3PB2 | 18157 | 18221 |
| CD33 | CD8SP-Ritx2-CD33-Him3-4 | 18126 | 18190 | HPV16-E7 | HPV16-7-8 | 18158 | 18222 |
| CD33 | CD33-SGNh2H12 | 18127 | 18191 | HPV16-E7 | HPV16-2 | 18159 | 18223 |
| CD33 | CD33-15G15-33 | 18128 | 18192 | TF1 | TF1-98 | 18160 | 18224 |

TABLE 6C

MHC I (HLA-A2) restricted peptides used for generation of SIR

| Protein | Fragment Name | PEPTIDE SEQ | SEQ ID |
|---|---|---|---|
| gp100 | G9-209 | IMDQVPFSV | 15764 |
| gp100 | G9-280 | YLEPGPVTV | 15765 |
| gp100 | G9-154 | KTWGQYWQV | 15766 |
| MUC1-A7 (130-138) | A7 | NLTISDVSV | 15767 |
| MUC1-D6 (13-21) | D6 | LLLTvLTVV | 15768 |
| TAX (11-19) | | LLFGYPVYV | 15769 |
| hTERT (540-548) | T540 | ILAKFLHWL | 15770 |
| hTERT (865-873) | T865 | RLVDDFLLV | 15771 |
| HIV1 gag (77-85) | SL9 | SLYNTVATL | 15772 |
| CMV-pp65 (495-503) | | NLVPMVATV | 15773 |
| MART (26-35) | | EAAGIGILTV | 15774 |
| EBNA-3A (596-604) | | SVRDRLARL | 15775 |
| EBNA-3c | | LLDFVRFMGV | 15776 |
| WT1 | | RMFPNAPYL | 15777 |
| PR1 | | vLQELNVTV | 15778 |
| Ras | Ras9-G12V | LVWGAVGV | 15779 |
| HPV | HPV16-E7 | YMLDLQPET | 15780 |
| NY-ESO-1 | NY-ESO-1-(155-163) | QLSLLMWIT | 15781 |
| NY-ESO-1 | NY-ESO-1-(157-165) | SLLMWITQC | 15782 |
| NY-ESO-1 | NY-ESO-1-(157-167) | SLLMWITQCFL | 15783 |

TABLE 6D

Exemplary linkers used for generation of SIRs

| NAME | SEQ ID-DNA | SEQ ID-PRT | NAME | SEQ ID-DNA | SEQ ID-PRT |
|---|---|---|---|---|---|
| Myc-(P)-TAG | 701 | 2981 | IgCL | 715 | 2993 |
| MYC-TAG | 702 | 2982 | IgG1-CH1 | 716 | 2994 |
| MYC-TAG | 703 | 2983 | IgG2-0C CHI | 717 | 2995 |
| MYC2-TAG | 704 | 2984 | IgG2-IC CHI | 718 | 2996 |
| MYC4-TAG | 705 | 2985 | IgG3 CHI | 719 | 2997 |
| V5-TAG | 706 | 2986 | IgG4 CHI | 720 | 2998 |
| HA-TAG | 707 | 2987 | IgAI CHI | 721 | 2999 |
| HIS-TAG | 708 | 2988 | IgA2 CHI | 722 | 3000 |
| AVI-TAG | 709 | 2989 | IgD CHI | 723 | 3001 |

TABLE 6D-continued

Exemplary linkers used for generation of SIRs

| NAME | SEQ ID-DNA | SEQ ID-PRT | NAME | SEQ ID-DNA | SEQ ID-PRT |
|---|---|---|---|---|---|
| G4Sx2-TAG | 710 & 711 | 2990 | IgE CH1 | 724 | 3002 |
| StrepTagII | 712 & 713 | 2991 | IgM CH1 | 725 | 3003 |
| FLAG-TAG | 714 | 2992 | K-coil | 18925 | 18932 |
| PG4SP | 18922 | 18929 | EAAAK | 18926 | 18933 |
| PG4SP-v2 | 18923 | 18930 | EAAAK-v2 | 18927 | 18934 |
| E-coil | 18924 | 18931 | | | |

In one embodiment of the disclosure, a SIR construct comprises an scFv domain, wherein the scFv may be preceded by an optional leader sequence such as provided in SEQ ID NO: 2300, 2301 or 2302, and followed by an optional linker sequence such as provided in any one of SEQ ID NO:2981-2986, and a T cell receptor constant chain such as provided in SEQ ID NO: 3010 to 3020, SEQ ID NO: 3022 to 3044, SEQ ID NO: 3045 to 3052 (including mutants and variants as described herein), wherein the domains are contiguous with and in the same reading frame to form a single fusion protein. The linker sequence may or may not be present in a SIR construct. In one embodiment, a SIR contains two functional polypeptide units, in which case the two units are separated by a cleavable linker such as provided in SEQ ID NO: 3060 to 3064. The cleavable linker can be preceded by a short flexible linker (e.g. SGSG) such as SEQ ID NO: 3065 and a Furine Cleavage site (e.g. RAKR) such as SEQ ID NO: 3066. The two functional polypeptide units of a SIR can also be encoded by two different polynucleotides that are separated by an IRES sequence. Alternatively, the two different polynucleotides encoding the two functional polypeptide units of a SIR could be encoded by two different vectors.

In one embodiment, an exemplary SIR construct comprises a leader sequence (e.g., a leader sequence described herein), an extracellular antigen binding domain (e.g., an antigen binding domain described herein), an optional linker (e.g., a linker region described herein), and a T cell receptor constant chain (e.g., a T cell receptor constant chain described herein, including mutants and variants).

For example, an SIR of the disclosure can comprises an exemplary leader sequence selected from SEQ ID NO: 2300, 2301 and SEQ ID NO: 2302, linked to an antigen binding domain such as any antigen binding sequence identified in Table 5 and 6A-B, an optional linker sequence selected from SEQ ID NO:2981 to 2985 and 2986 (see, also Table 6D), linked to a T cell receptor constant chain domain comprising a sequence selected from the group consisting of SEQ ID NO: 3010 to 3020, 3022 to 3044, 3045 to 3051 and 3052 (and mutants and variants thereof as described herein). The SIR can further comprise a fusion of the extracellular domain of a T cell receptor constant chain and the extracellular, transmembrane, and cytosolic domains of CD3z such as provided in SEQ ID NO: 3021 and SEQ ID NO: 3045 and mutants and variants.

In any of the embodiments described herein, a SIR-expressing effector cell shows higher binding to a target antigen as compared to a corresponding cTCR-expressing effector cell (such as an effector cell presenting on its surface a cTCR comprising the antigen binding domain of the SIR, e.g., a cTCR comprising an scFv, a vL and/or a vH fragment comprising the antigen binding domains of the SIR) when compared under similar conditions. An exemplary SIR targeting CD19 is presented by CD8SP-FMC63-vL-V5-[hTCRb-KACIAH]-F-P2A-SP-FMC63-vH-Myc-[hTCRa-CSDVP]-F-F2A-PAC (SEQ ID NO:1200). The corresponding cTCR targeting CD19 is presented by CD8SP-FMC63-vL-[hTCRb-WT]-F-P2A-SP-FMC63-vH-[hTCRa-WT]-F-F2A-PAC (SEQ ID NO: 18280). The nucleotide and amino acid SEQ ID Nos of several exemplary cTCRs of the disclosure are provided in Tables 7A-7B. For example, in some embodiments, a SIR-expressing effector cell targeting CD19 has a higher binding to CD19-ECD-GGSG-NLuc-AcV5 fusion protein after 60 minutes incubation at 4° C. as compared to the corresponding cTCR-expressing effector cell under similar conditions. In some embodiments, a SIR-expressing effector cell has a higher specific-binding to target antigen as compared to the corresponding cTCR-expressing effector cell under similar conditions. The specific binding of a target antigen to SIR-expressing effector cells is measured by subtracting the binding value obtained with a control effector cell from the value obtained with a SIR-expressing effector cell. In some embodiment, a control effector cell is a parental effector cell that does not express any SIR, e.g., an untransduced T cell. In an alternate embodiment, a control effector cell is an effector cell that expresses a control SIR targeting an antigen other than the antigen targeted by the test SIR. An exemplary control SIR to compare the binding activity of a CD19-SIR is CD8SP-MPL-161-vL-V5-[hTCRb-KACIAH]-F-P2A-SP-161-vH-Myc-[hTCRa-CSDVP]-F-F2A-PAC (SEQ ID NO:1322). In some embodiments, the binding of a SIR-expressing effector cell to the target antigen after 60 minutes incubation at 4° C. is at least 5, 10, 20, 30, 40, 50% or 100% more than the binding of a corresponding cTCR-expressing effector cell. In some embodiments, the binding of a SIR expressing effector cell to the target antigen is at least 1.25-fold (e.g., 1.5-fold, 2-fold, 5-fold or 10-fold) more than the binding of a corresponding cTCR-expressing effector cell. In some embodiments, the binding of a SIR expressing effector cell to the target antigen is not more than 100,000 fold (e.g., 5000-fold, 10,000-fold, or 50,000-fold) higher than the binding of a corresponding cTCR-expressing effector cell. In some embodiments, the binding of a SIR expression effector cell to the target antigen is about 1.25 fold to about 100,000 fold higher (e.g., about 5 fold to about 50,000 fold, about 10 fold to about 10,000 fold, or about 100 fold to about 1000 fold, and any value between any of the foregoing ranges) than the binding to a corresponding cTCR-expressing effector cell. In some embodiments, the binding of a SIR expressing effector cell to the target antigen after 60 minutes incubation at 4° C. is at least 1.25-fold to less than about 100,000-fold more than the binding of a corresponding cTCR-expressing effector cell under similar conditions. In some embodiments, the SIR-expressing effector cell is a SIR T cell. In some embodiments, the SIR-expressing effector cell is a SIR-expressing Jurkat T cell.

In other embodiments described herein, the SIR-expressing effector cell shows lower binding to a target antigen as compared to a corresponding CAR-expressing effector cell (such as an effector cell presenting on its surface a CAR comprising the antigen binding domain of the SIR, e.g., a CAR comprising an scFv comprising the antigen binding domains of the SIR) when compared under similar conditions. An exemplary SIR targeting CD19 is presented by CD8SP-FMC63-vL-V5-[hTCRb-KACIAH]-F-P2A-SP-FMC63-vH-Myc-[hTCRa-CSDVP]-F-F2A-PAC (SEQ ID NO:1200). The corresponding CAR targeting CD19 is presented by CD8SP-FMC63(vL-vH)-Myc-BBz-T2A-PAC (SEQ ID NO: 4501). The nucleotide and amino acid SEQ ID NOs of several exemplary CARs are provided herein. For example, in some embodiments, a SIR-expressing effector cell targeting CD19 has a lower binding to CD19-ECD-GGSG-NLuc-AcV5 as compared to the corresponding CAR-expressing effector cell under similar conditions. In some embodiments, the binding of a SIR-expressing effector cell to the target antigen after 60 minutes incubation at 4° C. is at least 5% (e.g., 10, 20, 30, 40 or 50%, or any value between any of the foregoing integers) less than the binding of a corresponding CAR-expressing effector cell under similar conditions. In some embodiments, the binding of a SIR expressing effector cell to the target antigen is at least about 1.5-fold (e.g., 2-fold, 5-fold, 10-fold, 20-100 fold, 100-500 fold, 500-1000 fold, 1000-10,000 fold, 10,000-50,000 fold or 50,000-100,000 fold, or any integer there between) less than the binding of a corresponding CAR-expressing effector cell. In some embodiments, the binding of a SIR expressing effector cell to the target antigen after 60 minutes incubation at 4° C. is at least 1.25-fold to 100,000-fold less (or any value therebetween) than the binding of a corresponding CAR-expressing effector cell under similar conditions. In some embodiments, the SIR-expressing effector cell is a SIR T cell. In some embodiments, the SIR-expressing effector cell is a SIR-expressing Jurkat T cell.

In other embodiments described herein, the SIR-expressing effector cell shows higher binding to a target antigen as compared to a corresponding cTCR-expressing effector cell but lower binding to a target antigen as compared to a corresponding CAR-expressing effector cell when compared under similar conditions. For example, in some embodiments, a SIR-expressing effector cell targeting CD19 has a higher binding to CD19-ECD-GGSG-NLuc-AcV5 as compared to the corresponding cTCR-expressing effector cell but lower binding as compared to a corresponding CAR-expressing effector cell under similar conditions. In some embodiments, the binding of a SIR-expressing effector cell to the target antigen after 60 minutes incubation at 4° C. is at least 5% (e.g., 10, 20, 30, 40, 50% or 100%, or any value therebetween) more than the binding of a corresponding cTCR-expressing effector cell but at least 5% (e.g., 10, 20, 30, 40, 50, 60, 70, 80 or 90% or any value therebetween) less than the binding of a corresponding CAR-expressing effector cell under similar conditions. In some embodiments, the binding of a SIR expressing effector cell to the target antigen after 60 minutes incubation at 4° C. is at least 1.25-fold (e.g., 1.5-fold, 2-fold, 5-fold or 10-fold or any value therebetween) more than the binding of a corresponding cTCR-expressing effector cell under similar conditions but is at least 1.5-fold (e.g., 2-fold, 5-fold or 10-fold, or any value there between) less than the binding of a corresponding CAR-expressing effector cell. In some embodiments, the SIR-expressing effector cell is a SIR T cell. In some embodiments, the SIR-expressing effector cell is a SIR-expressing Jurkat T cell.

In other embodiments described herein, the SIR shows higher cell surface expression as compared to a corresponding cTCR when expressed in an effector cell and compared under similar conditions. An exemplary SIR targeting CD19 is presented by CD8SP-FMC63-vL-V5-[hTCRb-KACIAH]-F-P2A-SP-FMC63-vH-Myc-[hTCRa-CSDVP]-F-F2A-PAC (SEQ ID NO:1200). The corresponding cTCR targeting CD19 is presented by CD8SP-FMC63-vL-[hTCRb-WT]-F-P2A-SP-FMC63-vH-[hTCRa-WT]-F-F2A-PAC (SEQ ID NO: 18280). For example, in some embodiments, cell surface expression of SIR, as measured by binding with APC-conjugated Protein L, is higher than that of the corresponding cTCR when examined under similar conditions. In some embodiments, the SIR-expressing effector cell has more than about 5% (such as more than about any of 10, 15, 20, 25, 30, 35, 40, 45 or 50%, including any ranges between these values) binding to APC-conjugated Protein L after 60 minutes incubation as compared to a corresponding cTCR-expressing effector cell. In some embodiments, the SIR-expressing effector cell is a SIR T cell. The expression of the SIR and the corresponding cTCR on the surface of effector cells can be measured by alternate methods including binding with the CD8SP-ProteinL-GGSG-NLuc-4×FLAG-×2STREP-8×His fusion protein or staining with an epitope tag (e.g. a MYC tag) that is inserted in the extracellular domain of the SIR and the cTCR.

In yet other embodiments described herein, the SIR shows lower cell surface expression as compared to a corresponding CAR when expressed in an effector cell and compared under similar conditions. An exemplary SIR targeting CD19 is presented by CD8SP-FMC63-vL-V5-[hTCRb-KACIAH]-F-P2A-SP-FMC63-vH-Myc-[hTCRa-CSDVP]-F-F2A-PAC (SEQ ID NO:1200). The corresponding CAR targeting CD19 is presented by CD8SP-FMC63(vL-vH)-Myc-BBz-T2A-PAC (SEQ ID NO: 4501). For example, in some embodiments, cell surface expression of SIR, as measured by binding with APC-conjugated Protein L, is lower than that of the corresponding CAR when examined under similar conditions. In some embodiments, the binding of SIR expressing effector cell to APC-Protein L is at least 5% (e.g., 10, 20, 30, 40 or 50% or any value therebetween) less than the binding of a corresponding CAR-expressing effector cell under similar conditions. In some embodiments, the binding of a SIR expressing effector cell to APC-Protein L is at least 1.5-fold to about 1,000 fold (or any value there between) less than the binding of a corresponding CAR-expressing effector cell. In one embodiments, the binding of a SIR expressing effector cell to APC-Protein L is at least 2-fold to about 100 fold (or any value there between) less than the binding of a corresponding CAR-expressing effector cell. In some embodiments, the SIR-expressing effector cell is a SIR T cell. In some embodiments, the SIR-expressing effector cell is a SIR-expressing Jurkat T cell. The expression of the SIR and the corresponding CAR on the surface of effector cells can be measured by alternate methods including binding with the CD8SP-ProteinL-GGSG-NLuc-4×FLAG-×2STREP-8×His fusion protein or staining with an epitope tag (e.g. a MYC tag) that is inserted in the comparable location (e.g. N-terminal region) in the extracellular domain of the SIR and the CAR.

In any of some such embodiments described herein, the SIR shows higher cell surface expression as compared to a corresponding cTCR but lower expression as compared to a corresponding CAR when expressed in an effector cell and compared under similar conditions. For example, in some embodiments, cell surface expression of SIR, as measured by binding with APC-conjugated Protein L, is higher than that of corresponding cTCR but lower than that of the corresponding CAR when examined under similar conditions. In some embodiments, the SIR-expressing effector cell has more than about 5% (such as more than about 5, 10, 15, 20, 25, 30, 35, 40, or 45%, including any ranges between these values) binding to APC-conjugated Protein L after 60 minutes incubation as compared to a corresponding cTCR-expressing effector cell but less than about 50% (such as less than about 45, 40, 35, 30, 25, 20, 15, 10, 5, 4, 3, 2, 1%, including any ranges between these values) binding to APC-conjugated Protein L after 60 minutes incubation as compared to a corresponding CAR-expressing effector cell. In some embodiments, the SIR-expressing effector cell is a SIR T cell.

In other embodiments described herein, the SIR-expressing effector cell shows higher cytotoxicity to a target antigen expressing cell as compared to a corresponding cTCR-expressing effector cell (such as an effector cell presenting on its surface a cTCR comprising the antigen binding domain of the SIR, e.g., a cTCR comprising an scFv, a vL and/or a vH fragment comprising the antigen binding domains of the SIR) when compared under similar conditions. An exemplary SIR targeting CD19 is presented by CD8SP-FMC63-vL-V5-[hTCRb-KACIAH]-F-P2A-SP-FMC63-vH-Myc-[hTCRa-CSDVP]-F-F2A-PAC (SEQ ID NO:1200). The corresponding cTCR targeting CD19 is presented by CD8SP-FMC63-vL-[hTCRb-WT]-F-P2A-SP-FMC63-vH-[hTCRa-WT]-F-F2A-PAC (SEQ ID NO: 18280). The nucleotide and amino acid SEQ ID Nos of several exemplary SIRs and cTCRs of the disclosure are provided in Table 7A and D. For example, in some embodiments, a SIR-expressing effector cell targeting CD19 shows higher cytotoxicity towards RAJI-GLuc cells after 4 hours to 96 hours co-culture at 37° C. as compared to the corresponding cTCR-expressing effector cell under similar conditions. In some embodiments, a SIR-expressing effector cell has a higher specific cytotoxicity towards a cell expressing its target antigen as compared to the corresponding cTCR-expressing effector cell under similar conditions. The specific cytotoxicity of a SIR-expressing effector cells is measured by subtracting the cytotoxicity value obtained with a control effector cell from the value obtained with a SIR-expressing effector cell. In some embodiment, a control effector cell is a parental effector cell that does not express any SIR, e.g., an untransduced T cell. In an alternate embodiment, a control effector cell is an effector cell that expresses a control SIR targeting an antigen other than the test SIR. For example, an exemplary control SIR to compare the cytotoxic activity of a CD19SIR is CD8SP-MPL-161-vL-V5-[hTCRb-KACIAH]-F-P2A-SP-161-vH-Myc-[hTCRa-CSDVP]-F-F2A-PAC (SEQ ID NO:1322). In some embodiments, the cytotoxicity of a SIR-expressing effector cell to the target antigen-expressing cells (i.e. target cells) after 4 hours-96 hours co-culture at 37° C. is at least 5, 10, 20, 30, 40, 50% or 100% more than the cytotoxicity of a corresponding cTCR-expressing effector cell. In some embodiments, the cytotoxicity of a SIR expressing effector cell to the target cell is at least 1.25-fold, 1.5-fold, 2-fold, 5-fold or 10-fold more than that of a corresponding cTCR-expressing effector cell. In some embodiments, the SIR-expressing effector cell is a SIR T cell.

In another or further embodiment of any of the foregoing embodiments described herein, the SIR-expressing effector cell shows higher in vivo activity against a target antigen expressing cell as compared to a corresponding cTCR-expressing effector cell (such as an effector cell presenting on its surface a cTCR comprising the antigen binding domain of the SIR, e.g., a cTCR comprising an scFv, a vL and/or a vH fragment comprising the antigen binding domains of the SIR) when compared under similar conditions. An exemplary SIR targeting CD19 is presented by CD8SP-FMC63-vL-V5-[hTCRb-KACIAH]-F-P2A-SP-FMC63-vH-Myc-[hTCRa-CSDVP]-F-F2A-PAC (SEQ ID NO:1200). The corresponding cTCR targeting CD19 is presented by CD8SP-FMC63-vL-[hTCRb-WT]-F-P2A-SP-FMC63-vH-[hTCRa-WT]-F-F2A-PAC (SEQ ID NO: 18280). The nucleotide and amino acid SEQ ID Nos of several exemplary SIRs and cTCRs of the disclosure are provided in Table 7A and 7D. For example, in some embodiments, a SIR-expressing effector cell targeting CD19 shows higher in vivo activity towards RAJI-FLuc cells in an NSG mouse xenograft model as compared to the corresponding cTCR-expressing effector cell under similar conditions. In some embodiments, a SIR-expressing effector cell has a higher in vivo activity towards a cell expressing its target antigen as compared to the corresponding cTCR-expressing effector cell under similar conditions. The specific in vivo activity of a SIR-expressing effector cells is measured by subtracting the in vivo activity (e.g. tumor reduction or reduction in bioluminescence value obtained from a FLuc expressing tumor) obtained with a control effector cell from the value obtained with a SIR-expressing effector cell. In some embodiment, a control effector cell is a parental effector cell that does not express any SIR, e.g., an untransduced T cell. In an alternate embodiment, a control effector cell is an effector cell that expresses a control SIR targeting an antigen other than an antigen targeted by the test SIR. For example, an exemplary control SIR to compare the in vivo activity of a CD19 SIR is CD8SP-MPL-161-vL-V5-[hTCRb-KACIAH]-F-P2A-SP-161-vH-Myc-[hTCRa-CSDVP]-F-F2A-PAC (SEQ ID NO:1322). In some embodiments, the in vivo activity of a SIR-expressing effector cell to the target antigen-expressing cells (i.e. target cells) in a NSG mouse xenograft model is at least 5, 10, 20, 30, 40, 50% or 100% more than the in vivo activity of a corresponding cTCR-expressing effector cell. In some embodiments, the in vivo activity of a SIR expressing effector cell to the target cell is at least 1.25-fold, 1.5-fold, 2-fold, 5-fold or 10-fold more than the in vivo activity of a corresponding cTCR-expressing effector cell. In some embodiments, the SIR-expressing effector cell is a SIR T cell. In some embodiments, the in vivo activity of a SIR expressing effector cell is measured by other methods, such as improvement in survival or reduction in tumor volume as measured using calipers.

In another or further embodiment of any of the foregoing embodiments described herein, the SIR-expressing effector cell shows higher TNFα production when cocultured with their target cells (e.g., a cell expressing their target antigen) as compared to a corresponding cTCR-expressing effector cell (such as an effector cell presenting on its surface a cTCR comprising the antigen binding domain of the SIR, e.g., a cTCR comprising an scFv, a vL and/or a vH fragment comprising the antigen binding domains of the SIR) when compared under similar conditions. An exemplary SIR targeting CD19 is presented by CD8SP-FMC63-vL-V5-[hTCRb-KACIAH]-F-P2A-SP-FMC63-vH-Myc-[hTCRa-CSDVP]-F-F2A-PAC (SEQ ID NO:1200). The corresponding cTCR targeting CD19 is presented by CD8SP-FMC63-vL-[hTCRb-WT]-F-P2A-SP-FMC63-vH-[hTCRa-WT]-F-F2A-PAC (SEQ ID NO: 18280). The nucleotide and amino acid SEQ ID Nos of several exemplary SIRs and cTCRs targeting different antigens are provided in Table 7A and 7D. For example, in some embodiments, a SIR-expressing effector cell targeting CD19 has higher TNFα production, as measured by ELISA, when co-cultured with Nalm6 target cells for 4 hours to 96 hours at 37° C. as compared to the corresponding cTCR-expressing effector cell under similar conditions. In some embodiments, a SIR-expressing effector cell has a higher fold-induced TNFα production as compared to the corresponding cTCR-expressing effector cell under similar conditions. The fold-induced TNFα production of SIR-expressing effector cells is measured by dividing the TNFα level obtained when the SIR-expressing cells are co-cultured with their target cells from the TNFα value obtained when SIR-expressing effector cells are cultured alone. In some embodiments, a SIR-expressing effector cell has a higher specific TNFα production when co-cultured with their target cell as compared to the corresponding cTCR-expressing effector cell under similar conditions. The specific TNFα production of a SIR-expressing effector cell when exposed to its target cell is measured by subtracting the TNFα value obtained with a control effector cell from the value obtained with a SIR-expressing effector cell when co-cultured with the target cell at 37° C. for 4 hours to 96 hours under similar conditions. In some embodiment, a control effector cell is a parental effector cell that does not express any SIR, e.g., an untransduced T cell. In an alternate embodiment, a control effector cell is an effector cell that expresses a control SIR targeting an antigen other than the antigen targeted by the test SIR. An exemplary control SIR to compare the binding activity of a CD19 SIR is CD8SP-MPL-161-vL-V5-[hTCRb-KACIAH]-F-P2A-SP-161-vH-Myc-[hTCRa-CSDVP]-F-F2A-PAC (SEQ ID NO:1322). In some embodiments, the specific TNFα production of a SIR-expressing effector cell to the target antigen after 24 hours incubation at 37° C. is at least 5, 10, 20, 30, 40, 50% or 100% more than the specific TNFα production of a corresponding cTCR-expressing effector cell. In some embodiments, the specific TNFα production of a SIR expressing effector cell is at least 1.25-fold, 1.5-fold, 2-fold, 5-fold or 10-fold more than the specific TNFα production of a corresponding cTCR-expressing effector cell. In some embodiments, the specific TNFα production of a SIR expressing effector cell is less than 100,000-fold more than the specific TNFα production of a corresponding cTCR-expressing effector cell. In some embodiments, the specific TNFα production of a SIR expressing effector cell is at least 1.25-fold, 1.5-fold, 2-fold, or 5-fold or 10-fold more than the specific TNFα production of a corresponding cTCR-expressing effector cell under similar conditions but less than 100,000-fold (e.g., less than 50,000 fold, 10,000 fold, or 1000 fold) more than the specific TNFα production of a corresponding cTCR-expressing effector cell under similar conditions. In some embodiments, the SIR-expressing effector cell is a SIR T cell.

In another or further embodiment of any of the foregoing embodiments described herein, the SIR-expressing effector cell shows higher IL2 production when cocultured with their target cells (e.g., a cell expressing their target antigen) as compared to a corresponding cTCR-expressing effector cell (such as an effector cell presenting on its surface a cTCR comprising the antigen binding domain of the SIR, e.g., a cTCR comprising an scFv, a vL and/or a vH fragment comprising the antigen binding domains of the SIR) when compared under similar conditions. An exemplary SIR targeting CD19 is presented by CD8SP-FMC63-vL-V5-[hTCRb-KACIAH]-F-P2A-SP-FMC63-vH-Myc-[hTCRa-CSDVP]-F-F2A-PAC (SEQ ID NO:1200). The corresponding cTCR targeting CD19 is presented by CD8SP-FMC63-vL-[hTCRb-WT]-F-P2A-SP-FMC63-vH-[hTCRa-WT]-F-F2A-PAC (SEQ ID NO: 18280). The nucleotide and amino acid SEQ ID Nos of several exemplary SIRs and cTCRs targeting different antigens are provided in Table 7A and 7D. For example, in some embodiments, a SIR-expressing effector cell targeting CD19 has higher IL2 production, as measured by ELISA, when co-cultured with Nalm6 target cells for 4 hours to 96 hours at 37° C. as compared to the corresponding cTCR-expressing effector cell under similar conditions. In some embodiments, a SIR-expressing effector cell has a higher fold-induced IL2 production as compared to the corresponding cTCR-expressing effector cell under similar conditions. The fold-induced IL2 production of SIR-expressing effector cells is measured by dividing the IL2 level obtained when the SIR-expressing cells are co-cultured with their target cells from the IL2 value obtained when SIR-expressing effector cells are cultured alone. In some embodiments, a SIR-expressing effector cell has a higher specific IL2 production when co-cultured with their target cell as compared to the corresponding cTCR-expressing effector cell under similar conditions. The specific IL2 production of a SIR-expressing effector cell when exposed to its target cell is measured by subtracting the IL2 value obtained with a control effector cell from the value obtained with a SIR-expressing effector cell when co-cultured with the target cell at 37° C. for 4 hours to 96 hours under similar conditions. In some embodiment, a control effector cell is a parental effector cell that does not express any SIR, e.g., an untransduced T cell. In an alternate embodiment, a control effector cell is an effector cell that expresses a control SIR targeting an antigen other than the antigen targeted by the test SIR. An exemplary control SIR to compare the binding activity of a CD19 SIR is CD8SP-MPL-161-vL-V5-[hTCRb-KACIAH]-F-P2A-SP-161-vH-Myc-[hTCRa-CSDVP]-F-F2A-PAC (SEQ ID NO:1322). In some embodiments, the specific IL2 production of a SIR-expressing effector cell to the target antigen after 24 hours incubation at 37° C. is at least 5, 10, 20, 30, 40, 50% or 100% more than the specific IL2 production of a corresponding cTCR-expressing effector cell. In some embodiments, the specific IL2 production of a SIR expressing effector cell is at least 1.25-fold, 1.5-fold, 2-fold, 5-fold or 10-fold more than the specific IL2 production of a corresponding cTCR-expressing effector cell. In some embodiments, the specific IL2 production of a SIR expressing effector cell is less than 100,000-fold more than the specific IL2 production of a corresponding cTCR-expressing effector cell. In some embodiments, the specific IL2 production of a SIR expressing effector cell is at least 1.25-fold, 1.5-fold, 2-fold, or 5-fold or 10-fold more than the specific IL2 production of a corresponding cTCR-expressing effector cell under similar conditions but less than 100,000-fold (e.g., less than 50,000 fold, 10,000 fold, or 1000 fold) more than the specific IL2 production of a corresponding cTCR-expressing effector cell under similar conditions. In some embodiments, the SIR-expressing effector cell is a SIR T cell. In some embodiments, the SIR-expressing effector cell is a SIR-expressing Jurkat T cell.

In another or further embodiment of any of the foregoing embodiments described herein, the SIR-expressing effector cell shows lower TNFα and/or IL2 production when cocultured with their target cells (e.g., a cell expressing their target antigen) as compared to a corresponding CAR-expressing effector cell (such as an effector cell presenting on its surface a CAR comprising the antigen binding domain of the SIR, e.g., a CAR comprising an scFv, a vL and/or a vH fragment comprising the antigen binding domains of the SIR) when compared under similar conditions. An exemplary SIR targeting CD19 is presented by CD8SP-FMC63-vL-V5-[hTCRb-KACIAH]-F-P2A-SP-FMC63-vH-Myc-[hTCRa-CSDVP]-F-F2A-PAC (SEQ ID NO:1200). For example, in some embodiments, a SIR-expressing effector cell targeting CD19 has higher TNFα and/or IL2 production, as measured by ELISA, when co-cultured with Nalm6 target cells for 4 hours to 96 hours at 37° C. as compared to the corresponding cTCR-expressing effector cell under similar conditions but lower higher TNFα and/or IL2 production as compared to a corresponding CAR-expressing effector cell under similar conditions. In some embodiments, a SIR-expressing effector cell has a higher fold-induced TNFα and/or IL2 production as compared to the corresponding cTCR-expressing effector cell but lower fold-induced TNFα and/or IL2 production as compared to the corresponding CAR-expressing effector cell under similar conditions. In some embodiments, a SIR-expressing effector cell has a higher specific TNFα and/or IL2 production when co-cultured with their target cell as compared to the corresponding cTCR-expressing effector cell but lower specific TNFα and/or IL2 production as compared to a CAR-expressing effector cell under similar conditions. In some embodiments, the specific TNFα and/or IL2 production of a SIR-expressing effector cell to the target antigen after 24 hours incubation at 37° C. is at least 5, 10, 20, 30, 40, 50% or 100% more than the specific TNFα and/or IL2 production of a corresponding cTCR-expressing effector cell but at least 5, 10, 20, 30, 40, 50% or 100% less than specific TNFα and/or IL2 production of a corresponding CAR-expressing effector cell. In some embodiments, the specific TNFα and/or IL2 production of a SIR expressing effector cell is at least 1.25-fold, 1.5-fold, 2-fold, 5-fold or 10-fold more than the specific TNFα and/or IL2 production of a corresponding cTCR-expressing effector cell but at least 1.25-fold, 1.5-fold, 2-fold, 5-fold or 10-fold less than the TNFα and/or IL2 production of a corresponding CAR-expressing effector cell under similar conditions. In some embodiments, the SIR-expressing effector cell is a SIR T cell. In some embodiments, the SIR-expressing effector cell is a SIR expressing Jurkat T cell.

In any of the embodiments described herein, an effector cell expressing a SIR of one type shows diverse properties as compared to an effector cell expressing a SIR of different type (such as an effector cell presenting on its surface a SIR comprising the antigen binding domain of the first SIR but with different TCR chains, e.g., a SIR comprising an scFv, a vL and/or a vH fragment comprising the antigen binding domains of the first SIR but with different TCR chains) when compared under similar conditions. Table 7A-C provides SEQ IDs of exemplary SIRs of different types. As SIRs are modular in design, additional SIR types can be generated by one skilled in the art by replacing one module with another. Exemplary properties in which SIRs of different type may show diversity when expressed in an immune effector cell include, but are not limited to, binding affinity, cell-surface expression, cytotoxicity, cytokine production, cellular proliferation, terminal differentiation, exhaustion and in vivo biological activity. In an exemplary embodiments, an effector cell expressing a SIR1 (SEQ ID NO: 1200) containing a FMC63 based CD19-targeting domain has a higher binding to CD19-ECD-GGSG-NLuc-AcV5 fusion protein after 60 minutes incubation at 4° C. as compared to a corresponding effector cells expressing SIR2 (SEQ ID NO: 1410) or SIR3 (SEQ ID NO: 4531) targeting CD19 when examined under similar conditions and when both SIR types are targeted to the TRAC (TCR alpha constant chain) genomic locus to rule out any variance in expression due to random sites of integration of different SIR constructs. In some embodiments, the target antigen-binding of an effector cell expressing a SIR of one type (e.g. SIR1) after 60 minutes incubation at 4° C. is at least 5, 10, 20, 30, 40, 50% or 100% more than the target antigen-binding of an effector cell expressing a SIR of a different type (e.g., SIR2) containing the same binding domain when examined under similar conditions and when both SIR types are targeted to the TRAC (TCR alpha constant chain) genomic locus. In some embodiments, the target antigen-binding of effector cells expressing SIR of different types (e.g. SIR1, SIR2, SIR3 and so on) containing the same binding domain after 60 minutes incubation at 4° C. varies by more than 5-fold, 10-fold, 20 fold, 50 fold or 100 fold when examined under similar conditions and when both SIR types are targeted to the TRAC (TCR alpha constant chain) genomic locus. Techniques to target a genomic insert to a specific genomic locus are known in the art. In some embodiments, the target antigen-binding of effector cells expressing SIR of different types (e.g. SIR1, SIR2, SIR3 and so on) containing the same binding domain after 60 minutes incubation at 4° C. varies by more than 5-fold, 10-fold, 20 fold, 50 fold or 100 fold when examined under similar conditions and when both the SIR types are targeted to the TRAC (TCR alpha constant chain) genomic locus. In some embodiments, the standard deviation in the target antigen-binding of effector cells expressing SIR of different types (e.g. SIR1, SIR2, SIR3 and so on) containing the same binding domain after 60 minutes incubation at 4° C. is more than 2-fold, 5-fold, 10-fold, 20 fold, 50 fold or 100 fold as compared to the standard deviation in the target antigen-binding of independently isolated populations of effector cells expressing a corresponding cTCR when examined under similar conditions and when the different SIR types and the cTCR are targeted to the TRAC locus. In other embodiments of the disclosure, the standard deviation in the cytotoxicity of effector cells expressing SIR of different types (e.g. SIR1, SIR2, SIR3 and so on) containing the same binding domain after 4 hours incubation at 37° C. with the target cells is more than 2-fold, 5-fold, 10-fold, 20 fold, 50 fold or 100 fold as compared to the standard deviation in the cytotoxicity of independently isolated populations of effector cells expressing a corresponding cTCR when each of the SIR types and the cTCR are inserted at the TRAC locus. Standard deviation is square root of variance and can be measured by methods known in the art. In some embodiments, the SIR-expressing effector cell is a SIR T cell. In some embodiments, the SIR-expressing effector cell is a SIR-expressing Jurkat T cell.

In any or some such embodiments described herein, the SIR comprises of wild-type and variant TCRa (e.g., SEQ ID NO: 732-740) and TCRb (e.g., SEQ ID NO: 747-762) constant chains that are encoded by human-codon optimized polynucleotides while the corresponding cTCR comprises of wild-type TCRa (SEQ ID NO: 730-731) and TCRb constant chains (SEQ ID NO: 744-746) that are encoded by their wild-type polynucleotide sequences. In some embodiments, the SIR also contains optional linkers joining the one or more antigen binding domains to the TCRa and TCRb constant chains. In some embodiments, the SIR comprises of wild-type and variant pre-TCRa (e.g., SEQ ID NO: 767-768) and TCRb constant chains (e.g., SEQ ID NO: 747-762) that are encoded by human-codon optimized polynucleotides while the corresponding cTCR comprises of wild-type TCRa and TCRb constant chains that are encoded by their wild-type polynucleotide sequences. In some embodiments, the SIR also contains optional linkers joining the one or more antigen binding domains to the pre-TCRa and TCRb chains. In any or some such embodiments described herein, the SIR comprises of wild-type and variant TCRg (e.g., SEQ ID NO: 770) and TCRd (e.g., SEQ ID NO: 772) constant chains that are encoded by human-codon optimized polynucleotides while the corresponding cTCR comprises of wild-type TCRg (SEQ ID NO: 769) and TCRd constant chains (SEQ ID NO: 771) that are encoded by their wild-type polynucleotide sequences. In some embodiments, the SIR also contains optional linkers joining the one or more antigen binding domains to the TCRa and TCRb constant chains. In some embodiments, the SIR comprises of wild-type and variant hTCRbECD-Bam-CD3zECDTMCP (SEQ ID NO: 10444-10452) and hTCRaECD-Kpn-CD3zECDTMCP-opt2 (SEQ ID NO: 10464-10471) constant chains while the corresponding cTCR comprises of wild-type TCRa and TCRb constant chains that are encoded by their wild-type polynucleotide sequences. In some embodiments, the SIR also contains optional linkers joining the one or more antigen binding domains to the hTCRbECD-Bam-CD3zECDTMCP (SEQ ID NO: 10444-10452) and hTCRaECD-Kpn-CD3zECDTMCP-opt2 (SEQ ID NO: 10464-10471) constant chains. CD19-ECD-GGSG-NLuc-AcV5 In some embodiment, the antigen binding domain has a disassociation constant ($K_D$, reflecting its binding affinity) from between about $10^{-4}$ M to $10^{-8}$ M. In some embodiments, the antigen binding domain binds to one or more of the antigens recited above. In some embodiment, the antigen binding domain has a $K_D$ of between about $10^{-4}$ M to $10^{-8}$ M, e.g., between about $10^{-5}$ M to $10^{-7}$ M, e.g., between about $10^{-5}$ M to $10^{-6}$ M, for the target antigen. In one embodiment, the binding affinity of the antigen binding domain is at least five-fold, 10-fold, 20-fold, 30-fold, 50-fold, 100-fold or 1,000-fold less than a reference antibody. In one embodiment, the encoded antigen binding domain has a binding affinity at least 5-fold less than a reference antibody. In some embodiments, the reference antibody is an antibody from which the antigen binding domain is derived.

In some embodiments, when present on the surface of a cell, binding of the antigen binding domain of said first chain of a double chain SIR to its cognate antigen is not substantially reduced by the presence of said second chain of SIR or the presence of a CAR. In some embodiments, binding of the antigen binding domain of said first chain of SIR to its cognate antigen in the presence of said second chain of SIR (or a CAR) is 70%, 80%, 85%, 90%, 95%, 96%, 97%, 98% or 99% of binding of the antigen binding domain of said first chain of SIR to its cognate antigen in the absence of said second chain of SIR (or a CAR) to its cognate antigen. For example, if a cell expresses a double chain SIR in which the first chain comprises of an scFV targeting CD19 joined to TCRα and the second chain comprises of a camelid vHH fragment targeting CD123 joined to TCRβ2, then the binding of the antigen binding domain of said first chain of SIR to its cognate antigen (i.e. CD19) in the presence of said second chain of SIR is 70%, 80%, 85%, 90%, 95%, 96%, 97%, 98% or 99% of binding of the antigen binding domain of said first chain of SIR to its cognate antigen (i.e. CD19) in the absence of said second chain of SIR to its cognate antigen (i.e. CD123). In another example, if a cell expresses a double chain SIR in which the first chain comprises of a vL fragment of FMC63 antibody targeting CD19 joined to TCRα and the second chain comprises of the vH fragment of FMC63 antibody targeting CD19 joined to TCRβ2, along with a CAR comprising vHH fragment targeting CD123, then the binding of the antigen binding domain of said first and second chains of the double chain SIR to their cognate antigen (i.e. CD19) in the presence of said CAR is 70%, 80%, 85%, 90%, 95%, 96%, 97%, 98% or 99% of binding of the antigen binding domain of said first and second chains of the double-chain of SIR to their cognate antigen (i.e. CD19) in the absence of said CAR to its cognate antigen (i.e. CD123).

In some embodiments, when present on the surface of a cell, the antigen binding domains of said first chain said second chain of a double chain SIR, associate with one another less than if both were scFv antigen binding domains. In some embodiments, the antigen binding domains of said first chain said second chain of a double chain SIR, associate with one another 5%, 10%, 20%, 30%, 40%, 50%, 60%, 70%, 80%, 90% or 99% less than if both were scFv antigen binding domains.

The SIR functional polypeptide units described herein may be encoded by a single polynucleotide chain and synthesized as single polypeptide chain, which is subsequently cleaved into different polypeptides. The SIR polypeptides may be initially synthesized comprising one or more leader sequences (also known as a signal peptide), which are subsequently removed from the mature polypeptides. In the preferred embodiment, each functional polypeptide unit (i.e. an antigen binding domain joined in frame to a T cell receptor constant chain plus Furine-SGSG-cleavable linker or a T cell receptor constant chain plus Furine-SGSG-cleavable linker) of SIR polypeptides is preceded by a leader sequence which direct the functional polypeptide unit of SIR to the cell surface as a type I transmembrane protein. In the preferred embodiment, the antigen-binding domain of SIR is extracellular-facing. In some embodiments, the leader sequence of SIR polypeptides comprises the sequence of SEQ ID NO: 2300 to SEQ ID NO: 2302.

In certain embodiments, the two T cell receptor constant chains of the SIR could be of the same type (i.e. TCRa and TCRa; TCRb and TCRb; preTCRa and preTCRa; TCR-gamma and TCRgamma; and TCR-delta and TCR-delta). Some Exemplary SIRs with the two TCR constant chains of the same type are Clone ID: 021116-E08 (SEQ ID NO: 905), Clone ID: 012216-P08 (SEQ ID NO: 906), Clone ID NO: 012216-Q05 (SEQ ID NO: 907), Clone ID NO: 012216-R04 (SEQ ID NO: 908) and Clone ID NO: 012216-S02 (SEQ ID NO: 909). In preferred embodiment, the two T cell receptor constant chains of the SIR are of different types (e.g., TCRa and TCRb; preTCRa and TCRb; TCRgamma and TCR-delta etc.). An exemplary SIR with a two TCR constant chain of different types is represented by Clone ID: 102615-C08, whose nucleic acid and amino acid sequences are given in SEQ ID NO: 1200 and SEQ ID NO: 3435, respectively.

In certain embodiments, the SIR polypeptides of comprise a single T cell receptor constant chain comprising of or derived from either TCRa, TCRb, pre-TCRa, TCR-gamma, or TCR-delta chains of human, mouse or canine origin. An exemplary SIR with a single TCR constant chain is represented by Clone ID: 051216-F04, whose amino acid sequence is SEQ ID NO: 3258.

In certain embodiments, SIR polypeptides of the disclosure encode for two T cell receptor constant chains comprising of or derived from TCRa, TCRb, pre-TCRa, TCR-gamma, or TCR-delta chains of human, mouse or canine origin. An exemplary SIR with a two TCR constant chain is represented by Clone ID: 102615-C08, whose nucleic acid and amino acid sequences are given in SEQ ID NO: 1200 and SEQ ID NO: 3435, respectively.

In certain embodiments, the two T cell receptor constant chains of the SIR polypeptides are of the same type (i.e.

TCRa and TCRa; TCRb and TCRb; preTCRa and preTCRa; TCRgamma and TCRgamma; and TCR-delta and TCR-delta). An exemplary SIR with the two TCR constant chains of the same type is Clone ID: 021116-E08 whose amino acid sequence is given in SEQ ID NO: 3140. In preferred embodiment, the two T cell receptor constant chains of the SIR polypeptides are of different types (e.g. TCRa and TCRb; preTCRa and TCRb; TCRgamma and TCR-delta etc.). An exemplary SIR with a two TCR constant chain of different types is represented by Clone ID: 102615-C08, whose nucleic acid and amino acid sequences are given in SEQ ID NO: 1200 and SEQ ID NO: 3435, respectively.

In some embodiments, neither of the two T cell receptor constant chains of the SIR polypeptides are wild type TCRa or wild type TCRb or wild-type TCRg or wild-type TCRd or wild-type preTCRa.

The following Tables summarize the target antigens, Clone IDs, SEQ ID (DNA), SEQ ID (PRT) and names of several exemplary SIRs described in by this disclosure. These constructs were made in general by combining the antigen binding fragments described in Tables 5-6 with exemplary variants of TCR constant chains described herein (including variants as provided in Tables 1-3). The SIRs are divided into different types (e.g., SIR1-SIR18) based on their backbone; i.e. the type of TCR constant chain present in them. However, it is to be understood that the SIR are modular in design and the scope of this disclosure is not limited to the SIRs described in the following Table and it is possible to generate different SIRs by switching the different modules. Thus, it is possible to combine the antigen binding domains with other variants of TCR constant chains, but which are not included in the SIRs described in the following Table 7. It is also possible to design SIR using antigen binding domains not listed in Tables 5-6. It is also possible to add or replace or remove the different Therapeutic and accessory modules, to the SIR. Thus, while the following Tables contain several SIRs with an antibiotic resistance gene (e.g., PAC), this module can be removed. In addition to SIRs of the disclosure, Table 7 also describes several Chimeric antigen receptors (CARs) containing the CD3z primary signaling domain and 41BB costimulatory domain. It is to be understood that similar CARs can be generated using other primary and costimulatory domains (e.g., from CD28). These CARs can be expressed in combination with SIRs described herein.

In Tables 7A-C, the SIR type refers to a construct backbone listed under "Exemplary SIR", each sequence has the same "backbone" but have different antigen binding domains. The Tables 7A-C can be used to determine the DNA and PRT SEQ ID NO of a construct containing a particular binding domain and belonging to a particular SIR type, cTCR or CAR. Thus, SEQ ID NO: 1200 has an FMC63 binding domain, while SEQ ID NO: 1201 has the same SIR backbone but has an huFMC63 antigen binding domain. The target antigens, DNA and PRT SEQ ID NO and names, including binding domain, of several exemplary constructs of SIR1 type are listed in Table 7D. The orders of the DNA and PRT SEQ ID NOs of different binding domains on the backbones SIR2-9 and cTCR in reference to the DNA and PRT SEQ ID NOs of SIR1 type are presented in Table 7A-B. Thus, by using Tables 7A and 7D, the DNA and PRT SEQ ID NO of any antigen binding domain on the SIR1-SIR6 type backbones and cTCR can be determined. Similarly, by using Tables 7B and 7D, the DNA and PRT SEQ ID NO of any antigen binding domain on the SIR7-SIR9 backbones types can be determined. The target antigens, DNA and PRT SEQ ID NO and names, including binding domains, of several exemplary constructs of SIR10 type are listed in Table 7E. The order of the DNA and PRT SEQ ID NOs of different binding domains on the backbones SIR10-18 and CARs in reference to the DNA and PRT SEQ ID NOs of SIR10 type is presented in Table 7C. Thus, by using Tables 7E and 7C, the DNA and PRT SEQ ID NO of any antigen binding domain on the SIR10-SIR18 type backbones and CARs can be determined. Alternatively, the sequence of a SIR containing a particular antigen binding domain of this disclosure can be determined by homology searching of the SEQ Listing file accompanying this disclosure. Finally, since the SIRs are modular in design, the DNA and amino acid sequence of a SIR containing a particular module can be generated by simply substituting the module(s) present in SIR1 and SIR 10 types with the new module.

TABLE 7A

Guide to Sequence Identification of SIR1-SIR6 and cTCR in reference to SIR1

| SIR TYPE | Exemplary SIR | SEQ ID DNA | | SEQ ID PRT | |
|---|---|---|---|---|---|
| SIR1 | CD8SP-FMC63-vL-V5-[hTCRb-KACIAH]-F-P2A-SP-FMC63-vH-Myc-[hTCRa-CSDVP]-F-F2A-PAC | 1200-1399 | 11227-11335 | 3435-3634 | 13184-13292 |
| SIR2 | CD8SP-FMC63-vL-V5-[hTCRb-KACIAH]-F-P2A-SP-FMC63-vH-Myc-[preTCRa-Del48]-F-F2A-PAC | 1410-1609 | 11344-11452 | 3645-3844 | 13301-13409 |
| SIR3 | CD8SP-FMC63-vL-V5-[hTCRb-S57C-opt]-F-P2A-SP-FMC63-vH-Myc-[hTCRa-T48C-opt]-F-F2A-PAC | 4531-4730 | 11814-11922 | 6044-6243 | 13771-13879 |
| SIR4 | CD8SP-FMC63-vL-[hTCRb-opt2]-F-P2A-SP-FMC63-vH-[hTCRa-opt2]-F-F2A-PAC | 4741-4940 | 11933-12041 | 6254-6453 | 13890-13998 |
| SIR5 | CD8SP-FMC63-vL-[hTCRb-opt2]-F-P2A-SP-FMC63-vH-Myc-[preTCRa-Del48]-F-F2A-PAC | 4951-5150 | 15786-15894 | 6464-6663 | 16013-16121 |
| SIR6 | CD8SP-FMC63-vL-V5-[hTCRg1-opt]-F-P2A-SP-FMC63-vH-Myc-[hTCRd-opt]-F-F2A-PAC | 5375-5574 | 16240-16348 | 6884-7083 | 16467-16575 |
| cTCR/SIR | CD8SP-FMC63-vL-[hTCRb-WT]-F-P2A-SP-FMC63-vH-[hTCRa-WT]-F-F2A-PAC | 18280-18479 | 18480-18588 | 18590-18789 | 18790-18898 |

TABLE 7B

Guide to Sequence identification of SIR1, and SIR7-9 types with SIR1 serving as reference.

| SIR TYPE | Exemplary SIR | SEQ ID DNA | | | | SEQ ID PRT | | |
|---|---|---|---|---|---|---|---|---|
| SIR1 | CD8SP-FMC63-vL-V5-[hTCRb-KACIAH]-F-P2A-SP-FMC63-vH-Myc-[hTCRa-CSDVP]-F-F2A-PAC | 1200-1208 | 1210-1397 | 11227-11335 | 3435-3443 | 3445-3632 | 13184-13292 | |
| SIR7 | CD8SP-FMC63-vL-[hTCRa-CSDVP]-F-F2A-SP-FMC63-vH-[hTCRb-KACIAH]-F-P2A-Xba-PAC | 10596-10604 | 10605-10792 | 10797-10905 | 12553-12561 | 12562-12749 | 12754-12862 | |
| SIR8 | CD8SP-FMC63-vL-PG4SP-v2-[hTCRa-CSDVP]-F-F2A-SP-FMC63-vH-PG4SP-[hTCRb-KACIAH] | 18936-18944 | 18945-19132 | 19137-19245 | 19248-19256 | 19257-19444 | 19449-19557 | |
| SIR9 | CD8SP-FMC63-vL-[hTCRbECD-Bam-CD3zECDTMCP-opt]-F-P2A-SP-FMC63-vH-[hTCRaECD-Kpn-CD3zECDTMCP-opt2] | 10908-10916 | 10917-11104 | 11109-11217 | 12865-12873 | 12874-13061 | 13066-13174 | |

TABLE 7C

Guide to Sequence Identification of SIR10-SIR18 types and CAR with SIR10 serving as reference.

| SIR TYPE | Exemplary SIR | SEQ ID DNA | | SEQ ID PRT | |
|---|---|---|---|---|---|
| SIR10 | CD8SP-V5-[hTCRb-KACIAH]-F-P2A-CD8SP-FMC63-vL-Gly-Ser-Linker-FMC63-vH-Myc-[hTCRa-CSDVP]-F-F2A-PAC | 1620-1816 | 11454-11569 | 3855-4051 | 13411-13526 |
| SIR11 | CD8SP-V5-[hTCRb-KACIAH]-F-P2A-CD8SP-FMC63-vL-Gly-Ser-Linker-FMC63-vH-Myc4-[preTCRa-Del48]-F-F2A-PAC | 1835-2031 | 11571-11686 | 4069-4265 | 13528-13643 |
| SIR12 | CD8SP-MYC-[hTCRa-T48C-opt1]-F-F2A-SP-FMC63-vL-Gly-Ser-Linker-FMC63-vH-V5-[hTCRb-S57C-opt1]-F-P2A-PAC | 2050-2246 | 11688-11692, 11695, 11694, 11697-11805 | 4284-4480 | 13645-13649, 13652, 13651, 13654-13762 |
| SIR13 | CD8SP-[hTCRb-opt2]-F-P2A-CD8SP-FMC63-vL-Gly-Ser-Linker-FMC63-vH-Myc4-[preTCRa-Del48]-F-F2A-PAC | 5161-5357 | 15896-16011 | 6674-6870 | 16123-16238 |
| SIR14 | CD8SP-V5-[hTCRg1-opt]-F-P2A-CD8SP-FMC63-vL-Gly-Ser-Linker-FMC63-vH-Myc-[hTCRd-opt]-F-F2A-PAC | 5585-5781 | 16350-16465 | 7094-7290 | 16577-16692 |
| SIR15 | CD8SP-G4Sx2-[hTCRa-S61R-opt]-F-F2A-SP-FMC63-vL-Gly-Ser-Linker-FMC63-vH-G4Sx2-[hTCRb-R79G-opt]-F-P2A-PAC | 5799-5995 | 17864-17979 | 7304-7500 | 17981-18096 |
| SIR16 | CD8SP-FMC63-vL-Gly-Ser-Linker-FMC63-vH-[hTCRa-SDVP]-F-F2A-PAC | 7519-7715 | 16694-16809 | 8161-8357 | 16928-17043 |
| SIR17 | CD8SP-FMC63-vL-Gly-Ser-Linker-FMC63-vH-[hTCRb-KAIAH]-F-P2A-PAC | 7733-7929 | 16811-16926 | 8375-8571 | 17045-17160 |
| SIR18 | CD8SP-FMC63-vL-Gly-Ser-Linker-FMC63-vH-Myc4-[preTCRa-Del48]-F-F2A-PAC | 7947-8143 | | 8589-8785 | |
| CAR | CD8SP-FMC63-vL-Gly-Ser-Linker-FMC63-vH-Myc-CD8TM-BBz | 9659-9855 | 17630-17745 | 9873-10069 | 17747-17862 |

TABLE 7D

SIRs Targeting Different Antigens On SIR1-Type Backbone

| TARGET | CLONE ID | SEQ ID-DNA | SEQ ID-PRT | NAME |
|---|---|---|---|---|
| CD19 | 102615-C08 & 010616-C01 | 1200 | 3435 | CD8SP-FMC63-vL-V5-[hTCRb-KACIAH]-F-P2A-SP-FMC63-vH-Myc-[hTCRa-CSDVP]-F-F2A-PAC |
| CD19 | 072516-B05 | 1201 | 3436 | CD8SP-huFMC63-11-vL-V5-[hTCRb-KACIAH]-F-P2A-SP-huFMC63-11-vH-Myc-[hTCRa-CSDVP]-F-F2A-PAC |
| CD19 | 041216 I04 | 1202 | 3437 | CD8SP-CD19Bu12-vL-V5-[hTCRb-KACIAH]-F-P2A-SP-CD19Bu12-vH-Myc-[hTCRa-CSDVP]-F-F2A-PAC |
| CD19 | 042516 B03 | 1203 | 3438 | CD8SP2-CD19MM-vL-V5-[hTCRb-KACIAH]-F-P2A-SP-CD19MM-vH-Myc-[hTCRa-CSDVP]-F-F2A-PAC |
| CD19 |  | 1204 | 3439 | CD8SP-CD19-4G7-vL-V5-[hTCRb-KACIAH]-F-P2A-SP-CD19-4G7-vH-Myc-[hTCRa-CSDVP]-F-F2A-PAC |
| HIV1-env |  | 1205 | 3440 | CD8SP-HIV1-N6-vL-V5-[hTCRb-KACIAH]-F-P2A-SP-HIV1-N6-vH-Myc-[hTCRa-CSDVP]-F-F2A-PAC |
| ALK | 102616-D06 | 1206 | 3441 | CD8SP-Alk-48-vL-V5-[hTCRb-KACIAH]-F-P2A-SP-Alk-48-vH-Myc-[hTCRa-CSDVP]-F-F2A-PAC |
| ALK | 051816-Z01 | 1207 | 3442 | CD8SP-Alk-58-vL-V5-[hTCRb-KACIAH]-F-P2A-SP-Alk-58-vH-Myc-[hTCRa-CSDVP]-F-F2A-PAC |
| Amyloid | 102116-A05 | 1208 | 3443 | SP-Amyloid-158-vL-V5-[hTCRb-KACIAH]-F-P2A-SP-Amyloid-158-vH-Myc-[hTCRa-CSDVP]-F-F2A-PAC |
| Biotin |  | 1209 | 3444 | CD8SP-dc-Avidin-V5-[hTCRb-KACIAH]-F-P2A-SP-dc-Avidin-Myc-[hTCRa-CSDVP]-F-F2A-PAC |
| CD45 |  | 1210 | 3445 | CD8SP-BC8-CD45-vL-V5-[hTCRb-KACIAH]-F-P2A-SP-BC8-CD45-vH-Myc-[hTCRa-CSDVP]-F-F2A-PAC |
| BCMA | 102015-K02 | 1211 | 3446 | CD8SP-BCMA-J6M0-vL-V5-[hTCRb-KACIAH]-F-P2A-SP-BCMA-J6M0-vH-Myc-[hTCRa-CSDVP]-F-F2A-PAC |
| BCMA | 011116-A07 | 1212 | 3447 | CD8SP-BCMA-huC12A3-L3H3-vL-V5-[hTCRb-KACIAH]-F-P2A-SP-BCMA-huC12A3-L3H3-vH-Myc-[hTCRa-CSDVP]-F-F2A-PAC |
| BCMA | 101416-A05 | 1213 | 3448 | CD8SP-BCMA-ET-40-vL-Myc2-[hTCRb-KACIAH]-F-P2A-SP-BCMA-ET-40-vH-Myc4-[hTCRa-CSDVP]-F-F2A-PAC |
| BCMA | 103116-H02 | 1214 | 3449 | CD8SP-BCMA-ET-54-vL-Myc2-[hTCRb-KACIAH]-F-P2A-SP-BCMA-ET-54-vH-Myc-[hTCRa-CSDVP]-F-F2A-PAC |
| CCR4 | 091616-Z01 | 1215 | 3450 | CD8SP-CCR4-humAb1567-vL-Myc2-[hTCRb-KACIAH]-F-P2A-SP-CCR4-humAb1567-vH-Myc4-[hTCRa-CSDVP]-F-F2A-PAC |
| HIV1-env |  | 1216 | 3451 | CD8SP-CD4-ECD-V5-[hTCRb-KACIAH]-F-P2A-SP-DC-SIGN-Myc-[hTCRa-CSDVP]-F-F2A-PAC |
| CD5 | 032416-A05 | 1217 | 3452 | CD8SP-CD5-9-vL-V5-[hTCRb-KACIAH]-F-P2A-SP-CD5-9-vH-Myc-[hTCRa-CSDVP]-F-F2A-PAC |
| CD5 |  | 1218 | 3453 | CD8SP-CD5-18-vL-V5-[hTCRb-KACIAH]-F-P2A-SP-CD5-18-vH-Myc-[hTCRa-CSDVP]-F-F2A-PAC |
| Ig Fc | 091616-A01 | 1219 | 3454 | CD8SP-V5-CD16A-V158-ECD-v1-V5-[hTCRb-KACIAH]-P2A-CD8SP2-CD16A-V158-ECD-v2-Myc-[hTCRa-CSDVP]-F-F2A-PAC |
| Ig Fc |  | 1220 | 3455 | CD8SP-V5-CD16A-V158-ECD-v1-V5-[hTCRb-KACIAH]-P2A-SP-CD123-1-Myc-[hTCRa-CSDVP]-F-F2A-PAC |
| CD20 | 100615-D05 | 1221 | 3456 | CD8SP-CD20-2F2-vL-V5-[hTCRb-KACIAH]-F-P2A-SP-CD20-2F2-vH-Myc-[hTCRa-CSDVP]-F-F2A-PAC |
| CD20 |  | 1222 | 3457 | CD8SP-CD20-GA101-vL-V5-[hTCRb-KACIAH]-F-P2A-SP-CD20-GA101-vH-Myc-[hTCRa-CSDVP]-F-F2A-PAC |
| CD22 | 041216 P04 | 1223 | 3458 | CD8SP-CD22-h10F4v2-vL-V5-[hTCRb-KACIAH]-F-P2A-SP-CD22-h10F4v2-vH-Myc-[hTCRa-CSDVP]-F-F2A-PAC |
| CD22 | 050516-V06 | 1224 | 3459 | CD8SP-CD22-H22Rhov2ACDRKA-vL-V5-[hTCRb-KACIAH]-F-P2A-SP-CD22- |

TABLE 7D-continued

SIRs Targeting Different Antigens On SIR1-Type Backbone

| TARGET | CLONE ID | SEQ ID-DNA | SEQ ID-PRT | NAME |
|---|---|---|---|---|
| | | | | H22Rhov2ACDRKA-vH-Myc-[hTCRa-CSDVP]-F-F2A-PAC |
| CD22 | 102715-E07 | 1225 | 3460 | CD8SP-CD22-m971-vL-V5-[hTCRb-KACIAH]-F-P2A-SP-CD22-m971-vH-Myc-[hTCRa-CSDVP]-F-F2A-PAC |
| CD30 | 121815-H03 | 1226 | 3461 | CD8SP-CD30-5F11-vL-V5-[hTCRb-KACIAH]-F-P2A-SP-CD30-5F11-vH-Myc-[hTCRa-CSDVP]-F-F2A-PAC |
| CD30 | 063016-K02 | 1227 | 3462 | CD8SP-CD30-Ac10-vL-V5-[hTCRb-KACIAH]-F-P2A-SP-CD30-Ac10-vH-Myc-[hTCRa-CSDVP]-F-F2A-PAC |
| CD32 | 101916-O03 | 1228 | 3463 | CD8SP-CD32-Med9-vL-V5-[hTCRb-KACIAH]-F-P2A-SP-CD32-Med9-vH-Myc-[hTCRa-CSDVP]-F-F2A-PAC |
| CD33 | 052416-K05 | 1229 | 3464 | CD8SP-CD33-AF5-vL-V5-[hTCRb-KACIAH]-F-P2A-SP-CD33-AF5-vH-Myc-[hTCRa-CSDVP]-F-F2A-PAC |
| CD33 | 011116-C06 | 1230 | 3465 | CD8SP-CD33-huMyc9-vL-V5-[hTCRb-KACIAH]-F-P2A-SP-CD33-huMyc9-vH-Myc-[hTCRa-CSDVP]-F-F2A-PAC |
| CD34 | | 1231 | 3466 | CD8SP-CD34-hu4C7-vL-V5-[hTCRb-KACIAH]-F-P2A-SP-CD34-hu4C7-vH-Myc-[hTCRa-CSDVP]-F-F2A-PAC |
| CD44v6 | | 1232 | 3467 | CD8SP-CD44v6-Biwa8-vL-V5-[hTCRb-KACIAH]-F-P2A-SP-CD44v6-Biwa8-vH-Myc-[hTCRa-CSDVP]-F-F2A-PAC |
| CD70 | | 1233 | 3468 | CD8SP-CD70-h1F6-vL-V5-[hTCRb-KACIAH]-F-P2A-SP-CD70-h1F6-vH-Myc-[hTCRa-CSDVP]-F-F2A-PAC |
| CD79b | 041216 K02 | 1234 | 3469 | CD8SP-CD79b-2F2-vL-V5-[hTCRb-KACIAH]-F-P2A-SP-CD79b-2F2-vH-Myc-[hTCRa-CSDVP]-F-F2A-PAC |
| CD123 | 100615-A02 | 1235 | 3470 | CD8SP-CD123-CSL362-vL-V5-[hTCRb-KACIAH]-F-P2A-SP-CD123-CSL362-vH-Myc-[hTCRa-CSDVP]-F-F2A-PAC |
| CD138 | 100815-A05 | 1236 | 3471 | CD8SP-CD138-vL-V5-[hTCRb-KACIAH]-F-P2A-SP-CD138-vH-Myc-[hTCRa-CSDVP]-F-F2A-PAC |
| CD179b | 063016-Y06 | 1237 | 3472 | CD8SP-CD179b-vL-V5-[hTCRb-KACIAH]-F-P2A-SP-CD179b-vH-Myc-[hTCRa-CSDVP]-F-F2A-PAC |
| CD276 | 050516-Q06 | 1238 | 3473 | CD8SP-CD276-17-vL-V5-[hTCRb-KACIAH]-F-P2A-SP-CD276-17-vH-Myc-[hTCRa-CSDVP]-F-F2A-PAC |
| CD324 | 071516-L04 | 1239 | 3474 | CD8SP-CD324-SC10-6-vL-V5-[hTCRb-KACIAH]-F-P2A-SP-CD324-SC10-6-vH-Myc4-[hTCRa-CSDVP]-F-F2A-PAC |
| CD324 | 071516-F03 | 1240 | 3475 | CD8SP-CD324-hSC10-17-vL-V5-[hTCRb-KACIAH]-F-P2A-SP-CD324-hSC10-17-vH-Myc4-[hTCRa-CSDVP]-F-F2A-PAC |
| CDH6 | 063016-T05 | 1241 | 3476 | CD8SP-CDH6-NOV710-vL-V5-[hTCRb-KACIAH]-F-P2A-SP-CDH6-NOV710-vH-Myc-[hTCRa-CSDVP]-F-F2A-PAC |
| CDH6 | 062816-U01 | 1242 | 3477 | CD8SP-CDH6-NOV712-vL-V5-[hTCRb-KACIAH]-F-P2A-SP-CDH6-NOV712-vH-Myc-[hTCRa-CSDVP]-F-F2A-PAC |
| CDH17 | 062816-X02 | 1243 | 3478 | CD8SP-CDH17-PTA001A4-vL-V5-[hTCRb-KACIAH]-F-P2A-SP-CDH17-PTA001A4-vH-Myc-[hTCRa-CSDVP]-F-F2A-PAC |
| CDH19 | 101216-B04 | 1244 | 3479 | CD8SP-CDH19-16A4-vL-V5-[hTCRb-KACIAH]-F-P2A-SP-CDH19-16A4-vH-Myc-[hTCRa-CSDVP]-F-F2A-PAC |
| EGFR | 071516-H04 | 1245 | 3480 | CD8SP-Cetuximab-vL-V5-[hTCRb-KACIAH]-F-P2A-SP-Cetuximab-vH-Myc4-[hTCRa-CSDVP]-F-F2A-PAC |
| CLEC5A | 050516-S08 | 1246 | 3481 | CD8SP-CLEC5A-8H8F5-vL-V5-[hTCRb-KACIAH]-F-P2A-SP-CLEC5A-8H8F5-vH-Myc-[hTCRa-CSDVP]-F-F2A-PAC |
| CLEC5A | 050516-U06 | 1247 | 3482 | CD8SP-CLEC5A-3E12A2-vL-V5-[hTCRb-KACIAH]-F-P2A-SP-CLEC5A-3E12A2-vH-Myc-[hTCRa-CSDVP]-F-F2A-PAC |
| GR/LHR | 090116-H03 | 1248 | 3483 | SP-CGHb-V5-[hTCRb-KACIAH]-F-P2A-SP-CGHa-Myc-[hTCRa-CSDVP]-F-F2A-PAC |

TABLE 7D-continued

SIRs Targeting Different Antigens On SIR1-Type Backbone

| TARGET | CLONE ID | SEQ ID-DNA | SEQ ID-PRT | NAME |
|---|---|---|---|---|
| CLL1 | | 1249 | 3484 | CD8SP-CLL1-M26-vL-V5-[hTCRb-KACIAH]-F-P2A-SP-CLL1-M26-vH-Myc-[hTCRa-CSDVP]-F-F2A-PAC |
| CLL1 | 021216-I03 | 1250 | 3485 | CD8SP-CLL1-M32-vL-V5-[hTCRb-KACIAH]-F-P2A-SP-CLL1-M32-vH-Myc-[hTCRa-CSDVP]-F-F2A-PAC |
| CMVpp65 | 121815-I03 | 1251 | 3486 | CD8SP-CMVpp65-F5-vL-V5-[hTCRb-KACIAH]-F-P2A-SP-CMVpp65-F5-vH-Myc-[hTCRa-CSDVP]-F-F2A-PAC |
| CS1 | | 1252 | 3487 | CD8SP-CS1-huLuc63-vL-V5-[hTCRb-KACIAH]-F-P2A-SP-huLuc63-vH-Myc-[hTCRa-CSDVP]-F-F2A-PAC |
| CS1 | 092916-E07 | 1253 | 3488 | CD8SP-HuLuc64-vL-V5-[hTCRb-KACIAH]-F-P2A-SP-HuLuc64-vH-Myc-[hTCRa-CSDVP]-F-F2A-PAC |
| CS1 | 012716-A02 | 1254 | 3489 | CD8SP-CS1-huLuc90-vL-V5-[hTCRb-KACIAH]-F-P2A-SP-huLuc90-vH-Myc-[hTCRa-CSDVP]-F-F2A-PAC |
| CSF2RA | | 1255 | 3490 | CD8SP-CSF2RA-Ab6-vL-V5-[hTCRb-KACIAH]-F-P2A-SP-CSF2RA-Ab6-vH-Myc-[hTCRa-CSDVP]-F-F2A-PAC |
| CSF2RA | 051816-C01 | 1256 | 3491 | CD8SP-CSF2RA-Ab1-vL-V5-[hTCRb-KACIAH]-F-P2A-SP-CSF2RA-Ab1-vH-Myc-[hTCRa-CSDVP]-F-F2A-PAC |
| CD123 | 111215-K06 | 1257 | 3492 | IgHSP-CD123-2-vHH-V5-[hTCRb-KACIAH]-F-P2A-SP-CD123-1-vHH-Myc-[hTCRa-CSDVP]-F-F2A-PAC |
| CD123 and Ig Fc | | 1258 | 3493 | IgHSP-CD123-2-vHH-V5-[hTCRb-KACIAH]-F-P2A-CD8SP1-CD16A-V158-ECD-v1-Myc-[hTCRa-CSDVP]-F-F2A-PAC |
| CD123 and Ig Fc | 042516 F05 | 1259 | 3494 | IgHSP-CD123-2-vHH-V5-[hTCRb-KACIAH]-F-P2A-CD8SP2-CD16A-V158-ECD-v2-Myc-[hTCRa-CSDVP]-F-F2A-PAC |
| CD123 and MPL | | 1260 | 3495 | IgHSP-CD123-2-vHH-V5-[hTCRb-KACIAH]-F-P2A-CD8SP-MPL-161-HL-Myc-[hTCRa-CSDVP]-F-F2A-PAC |
| CXCR4 and CD123 | 102615-B05 & 012216-V07 | 1261 | 3496 | CD8SP-CXCR4-1-vHH-V5-[hTCRb-KACIAH]-F-P2A-SP-CD123-1-vHH-Myc-[hTCRa-CSDVP]-F-F2A-PAC |
| CXCR4 and CD123 | | 1262 | 3497 | CD8SP-CXCR4-2-vHH-V5-[hTCRb-KACIAH]-F-P2A-SP-CD123-2-vHH-Myc-[hTCRa-CSDVP]-F-F2A-PAC |
| DLL3 | 071516-N04 | 1263 | 3498 | CD8SP-DLL3-hSC16-13-vL-V5-[hTCRb-KACIAH]-F-P2A-SP-DLL3-hSC16-13-vH-Myc4-[hTCRa-CSDVP]-F-F2A-PAC |
| DLL3 | 072116-C01 | 1264 | 3499 | CD8SP-DLL3-hSC16-56-vL-V5-[hTCRb-KACIAH]-F-P2A-SP-DLL3-hSC16-56-vH-Myc4-[hTCRa-CSDVP]-F-F2A-PAC |
| EBNA3c | 020416-S01 | 1265 | 3500 | CD8SP-EBNA3c-315-vL-V5-[hTCRb-KACIAH]-F-P2A-SP-EBNA3c-315-vH-Myc-[hTCRa-CSDVP]-F-F2A-PAC |
| EBV-gp350 | | 1266 | 3501 | CD8SP-EBV-gp350-vL-V5-[hTCRb-KACIAH]-F-P2A-SP-EBV-gp350-vH-Myc-[hTCRa-CSDVP]-F-F2A-PAC |
| EGFR | 032516-J08 and 042516 G01 | 1267 | 3502 | CD8SP-EGFR1-vHH-V5-[hTCRb-KACIAH]-F-P2A-SP-CEA1-vHH-Myc-[hTCRa-CSDVP]-F-F2A-PAC |
| EGFR | | 1268 | 3503 | CD8SP-EGFR33-vHH-V5-[hTCRb-KACIAH]-F-P2A-SP-CEA5-vHH-Myc-[hTCRa-CSDVP]-F-F2A-PAC |
| EGFRvIII | 100615-C06 | 1269 | 3504 | CD8SP-EGFRvIII-139-vL-V5-[hTCRb-KACIAH]-F-P2A-SP-EGFRvIII-139-vH-Myc-[hTCRa-CSDVP]-F-F2A-PAC |
| EGFRvIII | 101415-C03 | 1270 | 3505 | CD8SP-EGFRvIII-2173-vH-V5-[hTCRb-KACIAH]-F-P2A-SP-EGFRvIII-2173-vH-Myc-[hTCRa-CSDVP]-F-F2A-PAC |
| EpCam1 | 121815-B07 | 1271 | 3506 | CD8SP-Epcam1-MM1-vL-V5-[hTCRb-KACIAH]-F-P2A-SP-Epcam1-MM1-vH-Myc-[hTCRa-CSDVP]-F-F2A-PAC |
| EpCam1 | 121815-C05 | 1272 | 3507 | CD8SP-Epcam1-D5K5-vL-V5-[hTCRb-KACIAH]-F-P2A-SP-Epcam1-D5K5-vH-Myc-[hTCRa-CSDVP]-F-F2A-PAC |

TABLE 7D-continued

SIRs Targeting Different Antigens On SIR1-Type Backbone

| TARGET | CLONE ID | SEQ ID-DNA | SEQ ID-PRT | NAME |
|---|---|---|---|---|
| FLT3 | 050316-C01 | 1273 | 3508 | CD8SP-FLT3-NC7-vL-V5-[hTCRb-KACIAH]-F-P2A-SP-FLT3-NC7-vH-Myc-[hTCRa-CSDVP]-F-F2A-PAC |
| FITC | 050516-P08 | 1274 | 3509 | CD8SP-FITC-vL-V5-[hTCRb-KACIAH]-F-P2A-SP-FITC-vH-Myc-[hTCRa-CSDVP]-F-F2A-PAC |
| Influenza A HA | 101016-B06 | 1275 | 3510 | CD8SP-FLU-MEDI-8852-vL-V5-[hTCRb-KACIAH]-F-P2A-SP-FLU-MEDI-8852-vH-Myc-[hTCRa-CSDVP]-F-F2A-PAC |
| Folate Receptor a (FR1) | 102915-P07 | 1276 | 3511 | CD8SP-FR1-huMov19-vL-V5-[hTCRb-KACIAH]-F-P2A-SP-FR1-huMov19-vH-Myc-[hTCRa-CSDVP]-F-F2A-PAC |
| FSHR | 090116-E05 | 1277 | 3512 | CD8SP-FSHb-vL-V5-[hTCRb-KACIAH]-F-P2A-SP-CGHa-vH-Myc-[hTCRa-CSDVP]-F-F2A-PAC |
| GD2 | 111615-W05 | 1278 | 3513 | CD8SP-GD2-hu14-18-vL-V5-[hTCRb-KACIAH]-F-P2A-SP-GD2-hu14-18-vH-Myc-[hTCRa-CSDVP]-F-F2A-PAC |
| GD2 | 011416-E08 | 1279 | 3514 | CD8SP-GD2-hu3F8-vL-V5-[hTCRb-KACIAH]-F-P2A-SP-GD2-hu3F8-vH-Myc-[hTCRa-CSDVP]-F-F2A-PAC |
| GD3 | 050516-O06 | 1280 | 3515 | CD8SP-GD3-KM-641-vL-V5-[hTCRb-KACIAH]-F-P2A-SP-GD3-KM-641-vH-Myc-[hTCRa-CSDVP]-F-F2A-PAC |
| GFRa4 | 062816-V02 | 1281 | 3516 | CD8SP-GFRAlpha4-P4-6-vL-V5-[hTCRb-KACIAH]-F-P2A-SP-GFRAlpha4-P4-6-vH-Myc-[hTCRa-CSDVP]-F-F2A-PAC |
| GFRa4 | 062816-W05 | 1282 | 3517 | CD8SP-GFRa4-P4-10-vL-V5-[hTCRb-KACIAH]-F-P2A-SP-GFRa4-P4-10-vH-Myc-[hTCRa-CSDVP]-F-F2A-PAC |
| FUCOSYL-GM1 | 101216-Y07 | 1283 | 3518 | CD8SP-GM1-5B2-vL-V5-[hTCRb-KACIAH]-F-P2A-SP-GM1-5B2-vH-Myc-[hTCRa-CSDVP]-F-F2A-PAC |
| FUCOSYL-GM1 | 101916-K03 | 1284 | 3519 | CD8SP-GM1-7E5-vL-V5-[hTCRb-KACIAH]-F-P2A-SP-GM1-7E5-vH-Myc-[hTCRa-CSDVP]-F-F2A-PAC |
| GPRC5D | 100616-C03 | 1285 | 3520 | CD8SP-GPRC5D-ET150-5-vL-Myc2-[hTCRb-KACIAH]-F-P2A-SP-GPRC5D-ET150-5-vH-Myc4-[hTCRa-CSDVP]-F-F2A-PAC |
| GPRC5D | 102016-C04 | 1286 | 3521 | CD8SP-GPRC5D-ET150-18-vL-V5-[hTCRb-KACIAH]-F-P2A-SP-GPRC5D-ET150-18-vH-Myc-[hTCRa-CSDVP]-F-F2A-PAC |
| gp100 | | 1287 | 3522 | CD8SP-gp100-vL-V5-[hTCRb-KACIAH]-F-P2A-SP-gp100-vH-Myc-[hTCRa-CSDVP]-F-F2A-PAC |
| gp100 | | 1288 | 3523 | CD8SP-gp100-G2D12-vL-V5-[hTCRb-KACIAH]-F-P2A-SP-gp100-G2D12-vH-Myc-[hTCRa-CSDVP]-F-F2A-PAC |
| GPC3 | 103116-A04 | 1289 | 3524 | CD8SP-GPC3-4E5-vL-Myc2-[hTCRb-KACIAH]-F-P2A-SP-GPC3-4E5-vH-Myc-[hTCRa-CSDVP]-F-F2A-PAC |
| gpNMB | | 1290 | 3525 | CD8SP-gpNMB-115-vL-V5-[hTCRb-KACIAH]-F-P2A-SP-gpNMB-115-vH-Myc-[hTCRa-CSDVP]-F-F2A-PAC |
| GRP78 | | 1291 | 3526 | CD8SP-GRP78-GC18-vL-V5-[hTCRb-KACIAH]-F-P2A-SP-GRP78-GC18-vH-Myc-[hTCRa-CSDVP]-F-F2A-PAC |
| Her2 | | 1292 | 3527 | CD8SP-Her2-1-Darpin-V5-[hTCRb-KACIAH]-F-P2A-SP-Her2-2-Darpin-Myc-[hTCRa-CSDVP]-F-F2A-PAC |
| Her2 | | 1293 | 3528 | CD8SP-Her2-5F7-vHH-V5-[hTCRb-KACIAH]-F-P2A-SP-Her2-47D5-vHH-Myc-[hTCRa-CSDVP]-F-F2A-PAC |
| Her2 | 050516-W01 | 1294 | 3529 | CD8SP-Her2-Hu4D5-vL-V5-[hTCRb-KACIAH]-F-P2A-SP-Her2-Hu4D5-vH-Myc-[hTCRa-CSDVP]-F-F2A-PAC |
| Her2 and Her3 | | 1295 | 3530 | CD8SP-Her3-17B05So-vHH-V5-[hTCRb-KACIAH]-F-P2A-SP-Her2-2D3-vHH-Myc-[hTCRa-CSDVP]-F-F2A-PAC |
| HIV1-gag | | 1296 | 3531 | CD8SP-HIV1-E5-vL-V5-[hTCRb-KACIAH]-F-P2A-SP-HIV1-E5-vH-Myc-[hTCRa-CSDVP]-F-F2A-PAC |

TABLE 7D-continued

SIRs Targeting Different Antigens On SIR1-Type Backbone

| TARGET | CLONE ID | SEQ ID-DNA | SEQ ID-PRT | NAME |
|---|---|---|---|---|
| HIV1-env | 091616-Y01 | 1297 | 3532 | CD8SP-HIV1-3BNC117-vL-MYC2-[hTCRb-KACIAH]-F-P2A-SP-HIV1-3BNC117-vH-Myc4-[hTCRa-CSDVP]-F-F2A-PAC |
| HIV1-env |  | 1298 | 3533 | CD8SP-HIV1-PGT-128-vL-MYC2-[hTCRb-KACIAH]-F-P2A-SP-vH-Myc4-[hTCRa-CSDVP]-F-F2A-PAC |
| HIV1-env |  | 1299 | 3534 | CD8SP-HIV1-VR-C01-vL-MYC2-[hTCRb-KACIAH]-F-P2A-SP-HIV1-VR-C01-vH-Myc4-[hTCRa-CSDVP]-F-F2A-PAC |
| HIV1-env | 091616-X01 | 1300 | 3535 | CD8SP-HIV1-X5-vL-MYC2-[hTCRb-KACIAH]-F-P2A-SP-HIV1-X5-vH-Myc4-[hTCRa-CSDVP]-F-F2A-PAC |
| HMW-MAA | 051816-B07 | 1301 | 3536 | CD8SP-HMW-MAA-hIND-vL-V5-[hTCRb-KACIAH]-F-P2A-SP-HMW-MAA-hIND-vH-Myc-[hTCRa-CSDVP]-F-F2A-PAC |
| HTLV1-TAX |  | 1302 | 3537 | CD8SP-HTLV-TAX-T3F2-vL-V5-[hTCRb-KACIAH]-F-P2A-SP-TAX-T3F2-vH-Myc-[hTCRa-CSDVP]-F-F2A-PAC |
| HTLV1-TAX |  | 1303 | 3538 | CD8SP-HTLV-TAX-T3E3-vL-V5-[hTCRb-KACIAH]-F-P2A-SP-TAX-T3E3-vH-Myc-[hTCRa-CSDVP]-F-F2A-PAC |
| IL11Ra | 050516-R06 | 1304 | 3539 | CD8SP-IL11Ra-8E2-Ts107-vL-V5-[hTCRb-KACIAH]-F-P2A-SP-IL11Ra-8E2-Ts107-vH-Myc-[hTCRa-CSDVP]-F-F2A-PAC |
| IL6Ra and CD19 |  | 1305 | 3540 | IgHSP-IL6R-304-vHH-V5-[hTCRb-KACIAH]-F-P2A-SP-FMC63-scFV-Myc-[hTCRa-CSDVP]-F-F2A-PAC |
| IL13Ra2 | 051816-Y03 | 1306 | 3541 | CD8SP-IL13Ra2-hu107-vL-V5-[hTCRb-KACIAH]-F-P2A-SP-IL13Ra2-hu107vH-Myc-[hTCRa-CSDVP]-F-F2A-PAC |
| IL13Ra2 | 050516-T06 | 1307 | 3542 | CD8SP-IL13Ra2-Hu108-vL-V5-[hTCRb-KACIAH]-F-P2A-SP-IL13Ra2-Hu108-vH-Myc-[hTCRa-CSDVP]-F-F2A-PAC |
| KSHV-K8.1 | 110615-G08 | 1308 | 3543 | CD8SP-KSHV-4C3-vL-V5-[hTCRb-KACIAH]-F-P2A-SP-4C3-vH-Myc-[hTCRa-CSDVP]-F-F2A-PAC |
| LAMP1 | 101216-X03 | 1309 | 3544 | CD8SP-LAMP1-humab1-2-vL-V5-[hTCRb-KACIAH]-F-P2A-SP-LAMP1-humab1-2vH-Myc-[hTCRa-CSDVP]-F-F2A-PAC |
| LAMP1 | 051816-D07 | 1310 | 3545 | CD8SP-LAMP1-Mb4-vL-V5-[hTCRb-KACIAH]-F-P2A-SP-LAMP1-Mb4-vH-Myc-[hTCRa-CSDVP]-F-F2A-PAC |
| LewisY |  | 1311 | 3546 | CD8SP-LewisY-huS193-vL-V5-[hTCRb-KACIAH]-F-P2A-SP-LewisY-huS193-vH-Myc-[hTCRa-CSDVP]-F-F2A-PAC |
| L1CAM | 010716-G03 | 1312 | 3547 | CD8SP-L1CAM-9-3-HU3-vL-V5-[hTCRb-KACIAH]-F-P2A-SP-L1CAM-9-3-HU3-vH-Myc-[hTCRa-CSDVP]-F-F2A-PAC |
| LHR | 090116-G01 | 1313 | 3548 | SP-LHb-V5-[hTCRb-KACIAH]-F-P2A-SP-CGHa-Myc-[hTCRa-CSDVP]-F-F2A-PAC |
| Lym1 | 021216-H02 | 1314 | 3549 | CD8SP-Lym1-vL-V5-[hTCRb-KACIAH]-F-P2A-SP-Lym1-vH-Myc-[hTCRa-CSDVP]-F-F2A-PAC |
| Lym2 | 100615-B07 | 1315 | 3550 | CD8SP-Lym2-vL-V5-[hTCRb-KACIAH]-F-P2A-SP-Lym2-vH-Myc-[hTCRa-CSDVP]-F-F2A-PAC |
| CD79b |  | 1316 | 3551 | CD8SP-huMA79bv28-vL-V5-[hTCRb-KACIAH]-F-P2A-SP-huMA79bv28-vH-Myc-[hTCRa-CSDVP]-F-F2A-PAC |
| MART1 |  | 1317 | 3552 | CD8SP-MART1-CAG10-vL-V5-[hTCRb-KACIAH]-F-P2A-SP-MART1-CAG10-vH-Myc-[hTCRa-CSDVP]-F-F2A-PAC |
| MART1 |  | 1318 | 3553 | CD8SP-MART1-CLA12-vL-V5-[hTCRb-KACIAH]-F-P2A-SP-MART1-CLA12-vH-Myc-[hTCRa-CSDVP]-F-F2A-PAC |
| Mesothelin | 042516 E05 | 1319 | 3554 | CD8SP-Mesothelin-m912-vL-V5-[hTCRb-KACIAH]-F-P2A-SP-m912-vH-Myc-[hTCRa-CSDVP]-F-F2A-PAC |
| cMet and Her3 |  | 1320 | 3555 | CD8SP-cMET-171-vHH-V5-[hTCRb-KACIAH]-F-P2A-SP-Her3-21F06-vHH-Myc-[hTCRa-CSDVP]-F-F2A-PAC |
| MPL |  | 1321 | 3556 | CD8SP-MPL-175-vL-V5-[hTCRb-KACIAH]-F-P2A-SP-175-vH-Myc-[hTCRa-CSDVP]-F-F2A-PAC |

TABLE 7D-continued

SIRs Targeting Different Antigens On SIR1-Type Backbone

| TARGET | CLONE ID | SEQ ID-DNA | SEQ ID-PRT | NAME |
|---|---|---|---|---|
| MPL | | 1322 | 3557 | CD8SP-MPL-161-vL-V5-[hTCRb-KACIAH]-F-P2A-SP-161-vH-Myc-[hTCRa-CSDVP]-F-F2A-PAC |
| MPL | | 1323 | 3558 | CD8SP2-MPL-111-vL-V5-[hTCRb-KACIAH]-F-P2A-SP-MPL-111-vH-Myc-[hTCRa-CSDVP]-F-F2A-PAC |
| MPL | | 1324 | 3559 | CD8SP-MPL-178-vL-V5-[hTCRb-KACIAH]-F-P2A-SP-178-vH-Myc-[hTCRa-CSDVP]-F-F2A-PAC |
| MPL | | 1325 | 3560 | CD8SP-MPL-AB317-vL-V5-[hTCRb-KACIAH]-F-P2A-SP-AB317-vH-Myc-[hTCRa-CSDVP]-F-F2A-PAC |
| MPL | | 1326 | 3561 | CD8SP-MPL-12E10-vL-V5-[hTCRb-KACIAH]-F-P2A-SP-12E10-vH-Myc-[hTCRa-CSDVP]-F-F2A-PAC |
| MPL | | 1327 | 3562 | CD8SP-MPL-huVB22Bw5-vL-V5-[hTCRb-KACIAH]-F-P2A-SP-MPL-huVB22Bw5-vH-Myc-[hTCRa-CSDVP]-F-F2A-PAC |
| Muc1 | | 1328 | 3563 | CD8SP-Muc1-D6-M3B8-vL-V5-[hTCRb-KACIAH]-F-P2A-SP-Muc1-D6-M3B8-vH-Myc-[hTCRa-CSDVP]-F-F2A-PAC |
| Muc1 | | 1329 | 3564 | CD8SP-MUC1-D6-M3A1-vL-V5-[hTCRb-KACIAH]-F-P2A-SP-MUC1-D6-M3A1-vH-Myc-[hTCRa-CSDVP]-F-F2A-PAC |
| Muc16 | 121815-A02 | 1330 | 3565 | CD8SP-Muc16-4H11-vL-V5-[hTCRb-KACIAH]-F-P2A-SP-Muc16-4H11-vH-Myc-[hTCRa-CSDVP]-F-F2A-PAC |
| EGFR | 072116-A04 | 1331 | 3566 | CD8SP-Nimotuzumab-vL-V5-[hTCRb-KACIAH]-F-P2A-SP-Nimotuzumab-vH-Myc4-[hTCRa-CSDVP]-F-F2A-PAC |
| NKG2D Ligand | | 1332 | 3567 | CD8SP-NKG2D-(G4SG4D)-V5-[hTCRb-KACIAH]-F-P2A-SP-NKG2D-(G4SG4D)-v2-Myc-[hTCRa-CSDVP]-F-F2A-PAC |
| NKG2D | | 1333 | 3568 | CD8SP-NKG2D-MS-vL-V5-[hTCRb-KACIAH]-F-P2A-SP-NKG2D-MS-vH-Myc-[hTCRa-CSDVP]-F-F2A-PAC |
| NYBR1 | | 1334 | 3569 | CD8SP-NYBR1-vL-V5-[hTCRb-KACIAH]-F-P2A-SP-NYBR1-vH-Myc-[hTCRa-CSDVP]-F-F2A-PAC |
| NY-ESO | | 1335 | 3570 | CD8SP-NYESO-T1-vL-V5-[hTCRb-KACIAH]-F-P2A-SP-NYESO-T1-vH-Myc-[hTCRa-CSDVP]-F-F2A-PAC |
| NY-ESO | | 1336 | 3571 | CD8SP-NYESO-T1-vL-V5-[hTCRb-KACIAH]-F-P2A-SP-NYESO-T2-vH-Myc-[hTCRa-CSDVP]-F-F2A-PAC |
| PD1 ligand (e.g., PDL1) | | 1337 | 3572 | SP-PD1-ECD-V5-[hTCRb-KACIAH]-P2A-SP-PD1-opt-ECD-Myc-[hTCRa-CSDVP]-F-F2A-PAC |
| PDL1 | 101916-M03 | 1338 | 3573 | CD8SP-PDL1-Atezoli-vL-V5-[hTCRb-KACIAH]-F-P2A-SP-PDL1-Atezoli-vH-Myc-[hTCRa-CSDVP]-F-F2A-PAC |
| PDL1 | 101916-N07 | 1339 | 3574 | CD8SP-PDL1-SP142-vL-V5-[hTCRb-KACIAH]-F-P2A-SP-PDL1-SP142-vH-Myc-[hTCRa-CSDVP]-F-F2A-PAC |
| PDL1 | 102116-L01 | 1340 | 3575 | CD8SP-PDL1-10A5-vL-V5-[hTCRb-KACIAH]-F-P2A-SP-PDL1-10A5-vH-Myc-[hTCRa-CSDVP]-F-F2A-PAC |
| PSCA | | 1341 | 3576 | CD8SP-PSCA-Ha14-121-vL-V5-[hTCRb-KACIAH]-F-P2A-SP-PSCA-Ha14-121-vH-Myc-[hTCRa-CSDVP]-F-F2A-PAC |
| PSCA | | 1342 | 3577 | CD8SP-PSCA-Ha14-117-vL-V5-[hTCRb-KACIAH]-F-P2A-SP-PSCA-Ha14-117-vH-Myc-[hTCRa-CSDVP]-F-F2A-PAC |
| PR1 | 012216-A06 | 1343 | 3578 | CD8SP-PR1-vL-V5-[hTCRb-KACIAH]-F-P2A-SP-PR1-vH-Myc-[hTCRa-CSDVP]-F-F2A-PAC |
| PSMA | 011416-D01 | 1344 | 3579 | CD8SP-PSMA-006-vL-V5-[hTCRb-KACIAH]-F-P2A-SP-PSMA-006-vH-Myc-[hTCRa-CSDVP]-F-F2A-PAC |
| PSMA | 011216-A04 | 1345 | 3580 | CD8SP-PSMA-J591-vL-V5-[hTCRb-KACIAH]-F-P2A-SP-PSMA-J591-vH-Myc-[hTCRa-CSDVP]-F-F2A-PAC |
| PTK7 | 071516-103 | 1346 | 3581 | CD8SP-PTK7-hSC6-23-vL-V5-[hTCRb-KACIAH]-F-P2A-SP-PTK7-hSC6-23-vH-Myc4-[hTCRa-CSDVP]-F-F2A-PAC |

TABLE 7D-continued

SIRs Targeting Different Antigens On SIR1-Type Backbone

| TARGET | CLONE ID | SEQ ID-DNA | SEQ ID-PRT | NAME |
|---|---|---|---|---|
| PTK7 | 071516-G03 | 1347 | 3582 | CD8SP-PTK7-SC6-10-2-vL-V5-[hTCRb-KACIAH]-F-P2A-SP-PTK7-SC6-10-2-vH-Myc4-[hTCRa-CSDVP]-F-F2A-PAC |
| ROR1 | 100615-E04 | 1348 | 3583 | CD8SP-ROR1-4A5-vL-V5-[hTCRb-KACIAH]-F-P2A-SP-ROR1-4A5-vH-Myc-[hTCRa-CSDVP]-F-F2A-PAC |
| ROR1 | 012216-G07 | 1349 | 3584 | CD8SP-ROR1-4C10-vL-V5-[hTCRb-KACIAH]-F-P2A-SP-ROR1-4C10-vH-Myc-[hTCRa-CSDVP]-F-F2A-PAC |
| Mesothelin | | 1350 | 3585 | CD8SP-SD1-V5-[hTCRb-KACIAH]-F-P2A-SP-SD2-Myc-[hTCRa-CSDVP]-F-F2A-PAC |
| SLea | | 1351 | 3586 | CD8SP-SLea-7E3-vL-V5-[hTCRb-KACIAH]-F-P2A-SP-SLea-7E3-vH-Myc-[hTCRa-CSDVP]-F-F2A-PAC |
| SLea | | 1352 | 3587 | CD8SP-SLea-5B1-vL-V5-[hTCRb-KACIAH]-F-P2A-SP-SLea-5B1-vH-Myc-[hTCRa-CSDVP]-F-F2A-PAC |
| SSEA4 | | 1353 | 3588 | CD8SP-SSEA4-vL-V5-[hTCRb-KACIAH]-F-P2A-SP-SSEA4-vH-Myc-[hTCRa-CSDVP]-F-F2A-PAC |
| Tyrosinase | 021716-C04 | 1354 | 3589 | CD8SP-TA2-vL-V5-[hTCRb-KACIAH]-F-P2A-SP-TA2-vH-Myc-[hTCRa-CSDVP]-F-F2A-PAC |
| TCRB1 | 051716 C04 | 1355 | 3590 | CD8SP-TCRB1-CP01-E09-vL-V5-[hTCRb-KACIAH]-F-P2A-SP-TCRB1-CP01-E09-vH-Myc-[hTCRa-CSDVP]-F-F2A-PAC |
| TCRB1 | 051916-A08 | 1356 | 3591 | CD8SP-TCRB1-Jovi1-vL-V5-[hTCRb-KACIAH]-F-P2A-SP-TCRB1-Jovi1-vH-Myc-[hTCRa-CSDVP]-F-F2A-PAC |
| TCRB2 | 051716 D06 | 1357 | 3592 | CD8SP-TCRB2-CP01-D05-vL-V5-[hTCRb-KACIAH]-F-P2A-SP-TCRB2-CP01-D05-vH-Myc-[hTCRa-CSDVP]-F-F2A-PAC |
| TCRB2 | | 1358 | 3593 | CD8SP-TCRB2-CP01-E05-vL-V5-[hTCRb-KACIAH]-F-P2A-SP-TCRB2-CP01-E05-vH-Myc-[hTCRa-CSDVP]-F-F2A-PAC |
| TCRgd | | 1359 | 3594 | CD8SP-TCRgd-G5-4-vL-V5-[hTCRb-KACIAH]-F-P2A-SP-TCRgd-G5-4-vH-Myc-[hTCRa-CSDVP]-F-F2A-PAC |
| hTERT | | 1360 | 3595 | CD8SP-TERT-4A9-T540-vL-V5-[hTCRb-KACIAH]-F-P2A-SP-TERT-4A9-T540-vH-Myc-[hTCRa-CSDVP]-F-F2A-PAC |
| hTERT | | 1361 | 3596 | CD8SP-TERT-3G3-T865-vL-V5-[hTCRb-KACIAH]-F-P2A-SP-TERT-3G3-T865-vH-Myc-[hTCRa-CSDVP]-F-F2A-PAC |
| TGFBR2 | 063016-Z04 | 1362 | 3597 | CD8SP-TGFBR2-Ab1-vL-V5-[hTCRb-KACIAH]-F-P2A-SP-TGFBR2-Ab1-vH-Myc-[hTCRa-CSDVP]-F-F2A-PAC |
| TIM1 | | 1363 | 3598 | CD8SP-TIM1-HVCR1-270-2-vL-V5-[hTCRb-KACIAH]-F-P2A-SP-TIM1-HVCR1-270-2-vH-Myc-[hTCRa-CSDVP]-F-F2A-PAC |
| TIM1 | | 1364 | 3599 | CD8SP-TIM1-HVCR1-ARD5-vL-V5-[hTCRb-KACIAH]-F-P2A-SP-TIM1-HVCR1-ARD5vH-Myc-[hTCRa-CSDVP]-F-F2A-PAC |
| TnAg | 103116-E04 | 1365 | 3600 | CD8SP-TnAg-vL-V5-[hTCRb-KACIAH]-F-P2A-SP-TnAg-vH-Myc-[hTCRa-CSDVP]-F-F2A-PAC |
| Tn-Muc1 | | 1366 | 3601 | CD8SP-TnMuc1-hu5E5-RHA8-RKA-2-vL-V5-[hTCRb-KACIAH]-F-P2A-SP-TnMuc1-hu5E5-RHA8-RKA-2vH-Myc-[hTCRa-CSDVP]-F-F2A-PAC |
| TROP2 | 062816-S01 | 1367 | 3602 | CD8SP-TROP2-ARA47-HV3KV3-vL-V5-[hTCRb-KACIAH]-F-P2A-SP-TROP2-ARA47-HV3KV3-vH-Myc-[hTCRa-CSDVP]-F-F2A-PAC |
| TROP2 | 062816-R05 | 1368 | 3603 | CD8SP-TROP2-h7E6-SVG-vL-V5-[hTCRb-KACIAH]-F-P2A-SP-TROP2-h7E6-SVG-vH-Myc-[hTCRa-CSDVP]-F-F2A-PAC |
| TSHR | 090116-E02 | 1369 | 3604 | SP-TSHb-V5-[hTCRb-KACIAH]-F-P2A-SP-CGHa-Myc-[hTCRa-CSDVP]-F-F2A-PAC |
| TSHR | 071516-M03 | 1370 | 3605 | CD8SP-TSHR-K1-70-vL-V5-[hTCRb-KACIAH]-F-P2A-SP-TSHR-K1-70-vH-Myc4-[hTCRa-CSDVP]-F-F2A-PAC |
| TSHR | 051816-A07 | 1371 | 3606 | CD8SP-TSHR-KB1-vL-V5-[hTCRb-KACIAH]-F-P2A-SP-TSHR-KB1-vH-Myc-[hTCRa-CSDVP]-F-F2A-PAC |

TABLE 7D-continued

SIRs Targeting Different Antigens On SIR1-Type Backbone

| TARGET | CLONE ID | SEQ ID-DNA | SEQ ID-PRT | NAME |
|---|---|---|---|---|
| TSHR | | 1372 | 3607 | CD8SP-TSHR-5C9-vL-V5-[hTCRb-KACIAH]-F-P2A-SP-TSHR-5C9-vH-Myc-[hTCRa-CSDVP]-F-F2A-PAC |
| TSLPR | 010716-H05 | 1373 | 3608 | CD8SP-TSLPR-vL-V5-[hTCRb-KACIAH]-F-P2A-SP-TSLPR-vH-Myc-[hTCRa-CSDVP]-F-F2A-PAC |
| Tyrosinase | | 1374 | 3609 | CD8SP-Tyros-B2-vL-V5-[hTCRb-KACIAH]-F-P2A-SP-Tyros-B2-vH-Myc-[hTCRa-CSDVP]-F-F2A-PAC |
| Tyrosinase | | 1375 | 3610 | CD8SP-Tyros-MC1-vL-V5-[hTCRb-KACIAH]-F-P2A-SP-Tyros-MC1-vH-Myc-[hTCRa-CSDVP]-F-F2A-PAC |
| Tyrosinase | | 1376 | 3611 | CD8SP-Tyrosinase-B2-vL-V5-[hTCRb-KACIAH]-F-P2A-SP-Tyrosinase-B2-vH-Myc-[hTCRa-CSDVP]-F-F2A-PAC |
| VEGFR3 | | 1377 | 3612 | CD8SP-VEGFR3-Ab1-vL-V5-[hTCRb-KACIAH]-F-P2A-SP-VEGFR3-Ab1-vH-Myc-[hTCRa-CSDVP]-F-F2A-PAC |
| WT1 | 042516-C03 | 1378 | 3613 | CD8SP-WT1-Ab1-vL-V5-[hTCRb-KACIAH]-F-P2A-SP-WT1-Ab1-vH-Myc-[hTCRa-CSDVP]-F-F2A-PAC |
| WT1 | 042516-D03 | 1379 | 3614 | CD8SP-WT1-Ab5-vL-V5-[hTCRb-KACIAH]-F-P2A-SP-WT1-Ab5-vH-Myc-[hTCRa-CSDVP]-F-F2A-PAC |
| WT1 | 071516-J04 | 1380 | 3615 | CD8SP-MYC3-WT1-Ab13-vL-V5-[hTCRb-KACIAH]-F-P2A-SP-WT1-Ab13-vH-Myc4-[hTCRa-CSDVP]-F-F2A-PAC |
| WT1 | 071516-K04 | 1381 | 3616 | CD8SP-MYC3-WT1-Ab15-vL-V5-[hTCRb-KACIAH]-F-P2A-SP-WT1-Ab15-vH-Myc4-[hTCRa-CSDVP]-F-F2A-PAC |
| CD123 | 121516-I05 | 1382 | 3617 | CD8SP-CD123-1172-vL-V5-[hTCRb-KACIAH]-F-P2A-SP-CD123-1172-vH-Myc-[hTCRa-CSDVP]-F-F2A-PAC |
| CDH19 | 092916-A05 | 1383 | 3618 | CD8SP-CDH19-4B10-vL-V5-[hTCRb-KACIAH]-F-P2A-SP-CDH19-4B10-vH-Myc-[hTCRa-CSDVP]-F-F2A-PAC |
| Folate Receptor beta | 121516-H04 | | 3619 | CD8SP-FRbeta-m923-vL-V5-[hTCRb-KACIAH]-F-P2A-SP-FRbeta-m923-vH-Myc-[hTCRa-CSDVP]-F-F2A-PAC |
| LHR | 121516-M08 | 1385 | 3620 | CD8SP-LHR-8B7-vL-V5-[hTCRb-KACIAH]-F-P2A-SP-LHR-8B7-vH-Myc-[hTCRa-CSDVP]-F-F2A-PAC |
| LHR | 121516-L06 | 1386 | 3621 | CD8SP-LHR-5F4-21-vL-V5-[hTCRb-KACIAH]-F-P2A-SP-LHR-5F4-21-vH-Myc-[hTCRa-CSDVP]-F-F2A-PAC |
| B7H4 | 121516-O07 | 1387 | 3622 | CD8SP-B7H4-hu22C10-vL-V5-[hTCRb-KACIAH]-F-P2A-SP-B7H4-hu22C10-vH-Myc-[hTCRa-CSDVP]-F-F2A-PAC |
| B7H4 | 121516-N07 | 1388 | 3623 | CD8SP-B7H4-hu1D11-vL-V5-[hTCRb-KACIAH]-F-P2A-SP-B7H4-hu1D11-vH-Myc-[hTCRa-CSDVP]-F-F2A-PAC |
| IgE | 121516-P03 | 1389 | 3624 | CD8SP-IgE-omalizumab-vL-V5-[hTCRb-KACIAH]-F-P2A-SP-IgE-omalizumab-vH-Myc-[hTCRa-CSDVP]-F-F2A-PAC |
| CD23 | 011817-D05 | 1389 | 3625 | CD8SP-CD23-p5E8-vL-V5-[hTCRb-KACIAH]-F-P2A-SP-CD23-p5E8-vH-Myc-[hTCRa-CSDVP]-F-F2A-PAC |
| GCC | | 1389 | 3626 | CD8SP-GCC-5F9-vL-V5-[hTCRb-KACIAH]-F-P2A-SP-GCC-5F9-vH-Myc-[hTCRa-CSDVP]-F-F2A-PAC |
| GCC | 011817-B07 | 1389 | 3627 | CD8SP-GCC-Ab229-vL-V5-[hTCRb-KACIAH]-F-P2A-SP-GCC-Ab229-vH-Myc-[hTCRa-CSDVP]-F-F2A-PAC |
| CD200R | 111116-B07 | 11220 | 13177 | CD8SP-CD200R-huDx182-vL-[hTCRb-KACIAH]-F-P2A-SP-CD200R-huDx182-vH-[hTCRa-CSDVP]-F-F2A-PAC |
| AFP/MHC class I | 020217-B05 | 11221 | 13178 | CD8SP-AFP-61-vL-V5-[hTCRb-KACIAH]-F-P2A-SP-AFP-61-vH-Myc4-[hTCRa-CSDVP]-F-F2A-PAC |
| AFP/MHC class I | 020217-C08 | 11222 | 13179 | CD8SP-AFP-76-vL-V5-[hTCRb-KACIAH]-F-P2A-SP-AFP-76-vH-Myc4-[hTCRa-CSDVP]-F-F2A-PAC |

TABLE 7D-continued

SIRs Targeting Different Antigens On SIR1-Type Backbone

| TARGET | CLONE ID | SEQ ID-DNA | SEQ ID-PRT | NAME |
|---|---|---|---|---|
| AFP/MHC class I | 020717-R04 | 11223 | 13180 | CD8SP-AFP-79-vL-V5-[hTCRb-KACIAH]-F-P2A-SP-AFP-79-vH-Myc4-[hTCRa-CSDVP]-F-F2A-PAC |
| BCMA | 030817-C02 | 11224 | 13181 | CD8SP-BCMA-ET-03-vL-Myc2-[hTCRb-KACIAH]-F-P2A-SP-BCMA-ET-03-vH-Myc4-[hTCRa-CSDVP]-F-F2A-PAC |
| BCMA | 030817-A05 | 11225 | 13182 | CD8SP-BCMA-huC11.D5.3L1H3-vL-Myc2-[hTCRb-KACIAH]-F-P2A-SP-BCMA-huC11.D5.3L1H3-vH-Myc4-[hTCRa-CSDVP]-F-F2A-PAC |
| BCMA | 030817-B04 | 11226 | 13183 | CD8SP-BCMA-huC13-F12-vL-Myc2-[hTCRb-KACIAH]-F-P2A-SP-BCMA-huC13-F12-vH-Myc4-[hTCRa-CSDVP]-F-F2A-PAC |
| CD123 | | 11227 | 13184 | CD8SP-CD123-DART-1-vL-[hTCRb-KACIAH]-F-P2A-SP-CD123-DART-1-vH-[hTCRa-CSDVP]-F-F2A-PAC |
| CD123 | | 11228 | 13185 | CD8SP-CD123-DART-2-vL-[hTCRb-KACIAH]-F-P2A-SP-CD123-DART-2-vH-[hTCRa-CSDVP]-F-F2A-PAC |
| CD123 | | 11229 | 13186 | CD8SP-CD123-13RB18-vL-PG4SP-v2-[hTCRb-KACIAH]-F-P2A-SP-CD123-13RB18-vH-PG4SP-[hTCRa-CSDVP]-F-F2A-PAC |
| CD123 | | 11230 | 13187 | CD8SP-CD123-hu3E3-vL-[hTCRb-KACIAH]-F-P2A-SP-CD123-hu3E3-vH-[hTCRa-CSDVP]-F-F2A-PAC |
| CD123 | | 11231 | 13188 | CD8SP-CD123-9F6-vL-Myc2-[hTCRb-KACIAH]-F-P2A-SP-CD123-9F6-vH-Myc4-[hTCRa-CSDVP]-F-F2A-PAC |
| CD123 | | 11232 | 13189 | CD8SP-CD123-I3RB2-vL-[hTCRb-KACIAH]-F-P2A-SP-CD123-I3RB2-vH-[hTCRa-CSDVP]-F-F2A-PAC |
| CD123 | | 11233 | 13190 | CD8SP-CD123-1176-vL-[hTCRb-KACIAH]-F-P2A-SP-CD123-1176-vH-[hTCRa-CSDVP]-F-F2A-PAC |
| CD123 | | 11234 | 13191 | CD8SP-CD123-8B11-vL-V5-[hTCRb-KACIAH]-F-P2A-SP-CD123-8B11-vH-Myc4-[hTCRa-CSDVP]-F-F2A-PAC |
| CD123 | | 11235 | 13192 | CD8SP-CD123-2B8-vL-E-Coil-[hTCRb-KACIAH]-F-P2A-SP-CD123-2B8-vH-K-Coil-[hTCRa-CSDVP]-F-F2A-PAC |
| CD123 | | 11236 | 13193 | CD8SP-CD123-9D7-vL-[hTCRb-KACIAH]-F-P2A-SP-CD123-9D7-vH-[hTCRa-CSDVP]-F-F2A-PAC |
| CD123 | | 11237 | 13194 | CD8SP-CD123-3B10-vL-EAAAK-[hTCRb-KACIAH]-F-P2A-SP-CD123-3B10-vH-EAAAK-v2-[hTCRa-CSDVP]-F-F2A-PAC |
| CD19 | 011817-E01 | 11238 | 13195 | CD8SP-CD19-MEDI-3649-vL-V5-[hTCRb-KACIAH]-F-P2A-SP-CD19-MEDI-3649-vH-Myc-[hTCRa-CSDVP]-F-F2A-PAC |
| CD19 | 022817-J08 | 11239 | 13196 | CD8SP-CD19-Medrex-24D1-vL-Myc2-[hTCRb-KACIAH]-F-P2A-SP-CD19-Medrex-24D1-vH-Myc4-[hTCRa-CSDVP]-F-F2A-PAC |
| CD19 | 022817-L08 | 11240 | 13197 | CD8SP-CD19-MOR0028-vL-Myc2-[hTCRb-KACIAH]-F-P2A-SP-CD19-MOR0028-vH-Myc4-[hTCRa-CSDVP]-F-F2A-PAC |
| CD19 | 022817-M08 | 11241 | 13198 | CD8SP-CD19-HD37-H2L1-vL-Myc2-[hTCRb-KACIAH]-F-P2A-SP-CD19-HD37-H2L1-vH-Myc4-[hTCRa-CSDVP]-F-F2A-PAC |
| CD19 | 020217-W01 | 11242 | 13199 | CD8SP-CD19-huBly3-vL-V5-[hTCRb-KACIAH]-F-P2A-SP-CD19-huBly3-vH-Myc-[hTCRa-CSDVP]-F-F2A-PAC |
| CD19 | 020717-Q05 | 11243 | 13200 | CD8SP-CD19-huSJ25C1-vL-V5-[hTCRb-KACIAH]-F-P2A-SP-CD19-huSJ25C1-vH-Myc4-[hTCRa-CSDVP]-F-F2A-PAC |
| CD19 | 022817-K08 | 11244 | 13201 | CD8SP-CD19-hB4-vL-Myc2-[hTCRb-KACIAH]-F-P2A-SP-CD19-hB4-vH-Myc4-[hTCRa-CSDVP]-F-F2A-PAC |
| CD19 | 030817-V07 | 11245 | 13202 | CD8SP-CD19-hu-mROO5-vL-[hTCRb-KACIAH]-F-P2A-SP-CD19-hu-mROO5-vH-[hTCRa-CSDVP]-F-F2A-PAC |
| CD19 | | 11246 | 13203 | CD8SP-CD19-hA19-vL-V5-[hTCRb-KACIAH]-F-P2A-SP-CD19-hA19-vH-Myc4-[hTCRa-CSDVP]-F-F2A-PAC |

TABLE 7D-continued

SIRs Targeting Different Antigens On SIR1-Type Backbone

| TARGET | CLONE ID | SEQ ID-DNA | SEQ ID-PRT | NAME |
|---|---|---|---|---|
| CD20 | | 11247 | 13204 | CD8SP-CD20-Leu16-vL-V5-[hTCRb-KACIAH]-F-P2A-SP-CD20-Leu16-vH-Myc4-[hTCRa-CSDVP]-F-F2A-PAC |
| CD20 | | 11248 | 13205 | CD8SP-CD20-11B8-vL-V5-[hTCRb-KACIAH]-F-P2A-SP-CD20-11B8-vH-Myc4-[hTCRa-CSDVP]-F-F2A-PAC |
| CD20 | | 11249 | 13206 | CD8SP-CD20-2C6-vL-V5-[hTCRb-KACIAH]-F-P2A-SP-CD20-2C6-vH-Myc4-[hTCRa-CSDVP]-F-F2A-PAC |
| CD20 | 030817-X05 | 11250 | 13207 | CD8SP-CD20-2H7-vL-[hTCRb-KACIAH]-F-P2A-SP-CD20-2H7-vH-[hTCRa-CSDVP]-F-F2A-PAC |
| CD20 | | 11251 | 13208 | CD8SP-CD20-hA20-vL-[hTCRb-KACIAH]-F-P2A-SP-CD20-hA20-vH-[hTCRa-CSDVP]-F-F2A-PAC |
| CD20 | 030817-W07 | 11252 | 13209 | CD8SP-CD20-BM-CA-1925-v4-vL-[hTCRb-KACIAH]-F-P2A-SP-CD20-BM-CA-1925-V4-vH-[hTCRa-CSDVP]-F-F2A-PAC |
| CD20 | 031417-L06 | 11253 | 13210 | CD8SP-CD20-Ubli-v4-vL-[hTCRb-KACIAH]-F-P2A-SP-CD20-Ubli-v4-vH-[hTCRa-CSDVP]-F-F2A-PAC |
| CD20 | 030817-Y07 | 11254 | 13211 | CD8SP-CD20-h1F5-vL-[hTCRb-KACIAH]-F-P2A-SP-CD20-h1F5-vH-[hTCRa-CSDVP]-F-F2A-PAC |
| CD20 | 022817-T04 | 11255 | 13212 | CD8SP-CD20-7D8-vL-V5-[hTCRb-KACIAH]-F-P2A-SP-CD20-7D8-vH-Myc-[hTCRa-CSDVP]-F-F2A-PAC |
| CD20 | 030917-Z01 | 11256 | 13213 | CD8SP-CD20-AME-33-vL-[hTCRb-KACIAH]-F-P2A-SP-CD2O-AME-33-vH-[hTCRa-CSDVP]-F-F2A-PAC |
| CD33 | | 11257 | 13214 | CD8SP-CD33-Boehr2800308-vL-PG4SP-v2-[hTCRb-KACIAH]-F-P2A-SP-CD33-Boehr2800308-vH-PG4SP-[hTCRa-CSDVP]-F-F2A-PAC |
| CD33 | | 11258 | 13215 | CD8SP-CD33-Him3-4-vL-V5-[hTCRb-KACIAH]-F-P2A-SP-CD33-Him3-4-vH-Myc4-[hTCRa-CSDVP]-F-F2A-PAC |
| CD33 | | 11259 | 13216 | CD8SP-CD33-SGNh2H12-vL-[hTCRb-KACIAH]-F-P2A-SP-CD33-SGNh2H12-vH-[hTCRa-CSDVP]-F-F2A-PAC |
| CD33 | | 11260 | 13217 | CD8SP-CD33-15G15-33-vL-V5-[hTCRb-KACIAH]-F-P2A-SP-CD33-15G15-33-vH-Myc4-[hTCRa-CSDVP]-F-F2A-PAC |
| CD33 | | 11261 | 13218 | CD8SP-CD33-33H4-vL-PG4SP-v2-[hTCRb-KACIAH]-F-P2A-SP-CD33-33H4-vH-PG4SP-[hTCRa-CSDVP]-F-F2A-PAC |
| CD33 | | 11262 | 13219 | CD8SP-CD33-33H4-2-vL-EAAAK-[hTCRb-KACIAH]-F-P2A-SP-CD33-33H4-2-vH-EAAAK-V2-[hTCRa-CSDVP]-F-F2A-PAC |
| CD33 | | 11263 | 13220 | CD8SP-CD33-9C3-2-vL-EAAAK-[hTCRb-KACIAH]-F-P2A-SP-CD33-9C3-2-vH-EAAAK-v2-[hTCRa-CSDVP]-F-F2A-PAC |
| CD99 | | 11264 | 13221 | CD8SP-CD99-hu12E7-vL-PG4SP-v2-[hTCRb-KACIAH]-F-P2A-SP-CD99-hu12E7-vH-PG4SP-[hTCRa-CSDVP]-F-F2A-PAC |
| CLL1 | | 11265 | 13222 | CD8SP-CLL1-21C9-L2H3-vL-[hTCRb-KACIAH]-F-P2A-SP-CLL1-21C9-L2H3-vH-[hTCRa-CSDVP]-F-F2A-PAC |
| CLL1 | | 11266 | 13223 | CD8SP-CLL1-6E7L4H1e-vL-[hTCRb-KACIAH]-F-P2A-SP-CLL1-6E7L4H1e-vH-[hTCRa-CSDVP]-F-F2A-PAC |
| CLL1 | | 11267 | 13224 | CD8SP-CLL1-hu1075-v1-vL-PG4SP-v2-[hTCRb-KACIAH]-F-P2A-SP-CLL1-hu1075-v1-vH-PG4SP-[hTCRa-CSDVP]-F-F2A-PAC |
| CLL1 | | 11268 | 13225 | CD8SP-CLL1-hu1075-v2-vL-PG4SP-v2-[hTCRb-KACIAH]-F-P2A-SP-CLL1-hu1075-v2-vH-PG4SP-[hTCRa-CSDVP]-F-F2A-PAC |
| CS1 | | 11269 | 13226 | CD8SP-CS1-PDL241-vL-[hTCRb-KACIAH]-F-P2A-SP-CS1-PDL241-vH-[hTCRa-CSDVP]-F-F2A-PAC |
| CS1 | 022817-N08 | 11270 | 13227 | CD8SP-CS1-Hu27A-vL-Myc2-[hTCRb-KACIAH]-F-P2A-SP-CS1-Hu27A-vH-Myc4-[hTCRa-CSDVP]-F-F2A-PAC |

TABLE 7D-continued

SIRs Targeting Different Antigens On SIR1-Type Backbone

| TARGET | CLONE ID | SEQ ID-DNA | SEQ ID-PRT | NAME |
|---|---|---|---|---|
| CS1 | 022817-O05 | 11271 | 13228 | CD8SP-CS1-ScHu34C3-vL-Myc2-[hTCRb-KACIAH]-F-P2A-SP-CS1-ScHu34C3-vH-Myc4-[hTCRa-CSDVP]-F-F2A-PAC |
| CS1 | 020217-Y07 | 11272 | 13229 | CD8SP-CS1-Hu27A-vL-V5-[hTCRb-KACIAH]-F-P2A-SP-CS1-Hu27A-vH-Myc4-[hTCRa-CSDVP]-F-F2A-PAC |
| CS1 | 042117-C01 | 11273 | 13230 | CD8SP-CS1-Luc34-vL-Myc2-[hTCRb-KACIAH]-F-P2A-SP-CS1-Luc34-vH-Myc4-[hTCRa-CSDVP]-F-F2A-PAC |
| CS1 | | 11274 | 13231 | CD8SP-CS1-LucX2-vL-PG4SP-v2-[hTCRb-KACIAH]-F-P2A-SP-CS1-LucX2-vH-PG4SP-[hTCRa-CSDVP]-F-F2A-PAC |
| FITC | 020217-Z08 | 11275 | 13232 | CD8SP-FITC-4M-53-vL-V5-[hTCRb-KACIAH]-F-P2A-SP-FITC-4M-53-vH-Myc4-[hTCRa-CSDVP]-F-F2A-PAC |
| FITC | 020217-A01 | 11276 | 13233 | CD8SP-FITC-E2-vH-V5-[hTCRb-KACIAH]-F-P2A-SP-FITC-E2-vL-Myc4-[hTCRa-CSDVP]-F-F2A-PAC |
| GPRC5D | | 11277 | 13234 | CD8SP-GPRC5D-ET150-1-vL-[hTCRb-KACIAH]-F-P2A-SP-GPRC5D-ET150-1-vH-[hTCRa-CSDVP]-F-F2A-PAC |
| GPRC5D | | 11278 | 13235 | CD8SP-GPRC5D-ET150-2-vL-[hTCRb-KACIAH]-F-P2A-SP-GPRC5D-ET150-2-vH-[hTCRa-CSDVP]-F-F2A-PAC |
| HLA-A2 | | 11279 | 13236 | CD8SP-HLA-A2-3PB2-vL-[hTCRb-KACIAH]-F-P2A-SP-HLA-A2-3PB2-vH-[hTCRa-CSDVP]-F-F2A-PAC |
| HPV16-E7/MHC class I | | 11280 | 13237 | CD8SP-HPV16-7-8-vL-PG4SP-v2-[hTCRb-KACIAH]-F-P2A-SP-HPV16-7-8-vH-PG4SP-[hTCRa-CSDVP]-F-F2A-PAC |
| HPV16-E7/MHC I | | 11281 | 13238 | CD8SP-HPV16-2-vL-PG4SP-v2-[hTCRb-KACIAH]-F-P2A-SP-HPV16-2-vH-PG4SP-[hTCRa-CSDVP]-F-F2A-PAC |
| Tissue Factor 1 (TF1) | | 11282 | 13239 | CD8SP-TF1-98-vL-PG4SP-v2-[hTCRb-KACIAH]-F-P2A-SP-TF1-98-vH-PG4SP-[hTCRa-CSDVP]-F-F2A-PAC |
| Tn-Muc1 | | 11283 | 13240 | CD8SP-Tn-Muc1-5E5-vH-PG4SP-v2-[hTCRb-KACIAH]-F-P2A-SP-Tn-Muc1-5E5-vL-PG4SP-[hTCRa-CSDVP]-F-F2A-PAC |
| CD22 | 040417-R02 | 11284 | 13241 | CD8SP-CD22-5-vH-[hTCRb-KACIAH]-F-P2A-SP-CD22-5-vL-[hTCRa-CSDVP]-F-F2A-PAC |
| CD22 | 041117-S01 | 11285 | 13242 | CD8SP-CD22-10-vH-[hTCRb-KACIAH]-F-P2A-SP-CD22-10-vL-[hTCRa-CSDVP]-F-F2A-PAC |
| CD22 | 042117-O01 | 11286 | 13243 | CD8SP-CD22-31-vH-[hTCRb-KACIAH]-F-P2A-SP-CD22-31-vL-[hTCRa-CSDVP]-F-F2A-PAC |
| CD22 | 042517-Y05 | 11287 | 13244 | CD8SP-CD22-53-vH-[hTCRb-KACIAH]-F-P2A-SP-CD22-53-vL-[hTCRa-CSDVP]-F-F2A-PAC |
| CD22 | 042517-B02 | 11288 | 13245 | CD8SP-CD22-65-vH-[hTCRb-KACIAH]-F-P2A-SP-CD22-65-vL-[hTCRa-CSDVP]-F-F2A-PAC |
| Ig Kappa-Light Chain | | 11289 | 13246 | CD8SP-Kappa-LC1-vL-PG4SP-v2-[hTCRb-KACIAH]-F-P2A-SP-Kappa-LC1-vH-PG4SP-[hTCRa-CSDVP]-F-F2A-PAC |
| PTK7 | 080217-L08 | 11290 | 13247 | CD8SP-PTK7-7C8-vL-[hTCRb-KACIAH]-F-P2A-SP-PTK7-7C8-vH-[hTCRa-CSDVP]-F-F2A-PAC |
| PTK7 | | 11291 | 13248 | CD8SP-PTK7-12C6a-vL-[hTCRb-KACIAH]-F-P2A-SP-PTK7-12C6a-vH-[hTCRa-CSDVP]-F-F2A-PAC |
| CD19 | | 11292 | 13249 | CD8SP-hCD19-EUK5-13-vL-[hTCRb-KACIAH]-F-P2A-SP-hCD19-EUK5-13-vH-[hTCRa-CSDVP]-F-F2A-PAC |
| Ras/MHC class I | | 11293 | 13250 | CD8SP-Ras-Ab2-vL-PG4SP-v2-[hTCRb-KACIAH]-F-P2A-SP-Ras-Ab2-vH-PG4SP-[hTCRa-CSDVP]-F-F2A-PAC |
| Ras/MHC class I | | 11294 | 13251 | CD8SP-Ras-Ab4-vL-[hTCRb-KACIAH]-F-P2A-SP-Ras-Ab4-vH-[hTCRa-CSDVP]-F-F2A-PAC |

TABLE 7D-continued

SIRs Targeting Different Antigens On SIR1-Type Backbone

| TARGET | CLONE ID | SEQ ID-DNA | SEQ ID-PRT | NAME |
|---|---|---|---|---|
| CLD18A2 | 091417-A02 | 11295 | 13252 | CD8SP-CLD18A2-43A11-vL-PG4SP-v2-[hTCRb-KACIAH]-F-P2A-SP-CLD18A2-43A11-vH-PG4SP-[hTCRa-CSDVP]-F-F2A-PAC |
| CLD18A2 | | 11296 | 13253 | CD8SP-CLD18A2-175D10-vL-PG4SP-v2-[hTCRb-KACIAH]-F-P2A-SP-CLD18A2-175D10-vH-PG4SP-[hTCRa-CSDVP]-F-F2A-PAC |
| CD43 | 091417-B05 | 11297 | 13254 | CD8SP-CD43-huJL-1-257-10-vL-PG4SP-v2-[hTCRb-KACIAH]-F-P2A-SP-CD43-huJL-1-257-10-vH-PG4SP-[hTCRa-CSDVP]-F-F2A-PAC |
| CD69L | | 11298 | 13255 | CD8SP-CD69L-DREG200-vL-[hTCRb-KACIAH]-F-P2A-SP-CD69L-DREG200-vH-[hTCRa-CSDVP]-F-F2A-PAC |
| NY-ESO | | 11299 | 13256 | CD8SP-NYESO-35-15-vL-PG4SP-v2-[hTCRb-KACIAH]-F-P2A-SP-NYESO-35-15-vH-PG4SP-[hTCRa-CSDVP]-F-F2A-PAC |
| P-glycoprotein (MDR1) | | 11300 | 13257 | CD8SP-Pgp-9F11-vL-[hTCRb-KACIAH]-F-P2A-SP-Pgp-9F11-vH-[hTCRa-CSDVP]-F-F2A-PAC |
| Streptag | | 11301 | 13258 | CD8SP-Streptag-vL-[hTCRb-KACIAH]-F-P2A-SP-Streptag-vH-[hTCRa-CSDVP]-F-F2A-PAC |
| MPL/TPO-R | 080317-G07 | 11302 | 13259 | CD8SP-MPL-hu-161-2-vL-[hTCRb-KACIAH]-F-P2A-SP-MPL-hu-161-2-vH-[hTCRa-CSDVP]-F-F2A-PAC |
| P-glycoprotein (MDR1) | | 11303 | 13260 | CD8SP-Pgp-MRK16-vL-PG4SP-v2-[hTCRb-KACIAH]-F-P2A-SP-Pgp-MRK16-vH-PG4SP-[hTCRa-CSDVP]-F-F2A-PAC |
| BCMA | | 11304 | 13261 | CD8SP-BCMA-huC12A3-L3H3-vL2-[hTCRb-KACIAH]-F-P2A-SP-BCMA-huC12A3-L3H3-vH2-[hTCRa-CSDVP]-F-F2A-PAC |
| BCMA | | 11305 | 13262 | CD8SP-BCMA-huC13-F12-L1H2-vL2-[hTCRb-KACIAH]-F-P2A-SP-BCMA-huC13-F12-L1H2-vH-[hTCRa-CSDVP]-F-F2A-PAC |
| CD179a | | 11306 | 13263 | CD8SP-CD179a-2460-B04-vL-PG4SP-v2-[hTCRb-KACIAH]-F-P2A-SP-CD179a-2460-B04-vH-PG4SP-[hTCRa-CSDVP]-F-F2A-PAC |
| CD179a | | 11307 | 13264 | CD8SP-CD179a-2462-E07-vL-[hTCRb-KACIAH]-F-P2A-SP-CD179a-2462-E07-vH-[hTCRa-CSDVP]-F-F2A-PAC |
| MPL/TPO-R | | 11308 | 13265 | CD8SP-MPL-hu-175-2-vL-[hTCRb-KACIAH]-F-P2A-SP-MPL-hu-175-2-vH-[hTCRa-CSDVP]-F-F2A-PAC |
| MPL/TPO-R | | 11309 | 13266 | CD8SP-MPL-hu-111-2-vL-[hTCRb-KACIAH]-F-P2A-SP-MPL-hu-111-2-vH-[hTCRa-CSDVP]-F-F2A-PAC |
| CD19 | | 11310 | 13267 | CD8SP-hu-FMC65-1-vL-[hTCRb-KACIAH]-F-P2A-SP-hu-FMC65-1-vH-[hTCRa-CSDVP]-F-F2A-PAC |
| CD22 | 031417-A06 | 11311 | 13268 | CD8SP-CD22-HA22-vL-[hTCRb-KACIAH]-F-P2A-SP-CD22-HA22-vH-[hTCRa-CSDVP]-F-F2A-PAC |
| STEAP1 | | 11312 | 13269 | CD8SP-STEAP1-hu120-vL-PG4SP-v2-[hTCRb-KACIAH]-F-P2A-SP-STEAP1-hu120-vH-PG4SP-[hTCRa-CSDVP]-F-F2A-PAC |
| Liv1 | | 11313 | 13270 | CD8SP-hLiv1-mAb2-vL-PG4SP-v2-[hTCRb-KACIAH]-F-P2A-SP-hLiv1-mAb2-vH-PG4SP-[hTCRa-CSDVP]-F-F2A-PAC |
| Nectin-4 | | 11314 | 13271 | CD8SP-hu-Nectin4-mAb1-vL-PG4SP-v2-[hTCRb-KACIAH]-F-P2A-SP-hu-Nectin4-mAb1-vH-PG4SP-[hTCRa-CSDVP]-F-F2A-PAC |
| Cripto | | 11315 | 13272 | CD8SP-hu-Cripto-L1H2-vL-PG4SP-v2-[hTCRb-KACIAH]-F-P2A-SP-hu-Cripto-L1H2-vH-PG4SP-[hTCRa-CSDVP]-F-F2A-PAC |
| gpA33 | | 11316 | 13273 | CD8SP-hu-gpA33-vL-PG4SP-v2-[hTCRb-KACIAH]-F-P2A-SP-hu-gpA33-vH-PG4SP-[hTCRa-CSDVP]-F-F2A-PAC |
| ROR1 | | 11317 | 13274 | CD8SP-ROR1-DART4-vL-PG4SP-v2-[hTCRb-KACIAH]-F-P2A-SP-ROR1-DART4-vH-PG4SP-[hTCRa-CSDVP]-F-F2A-PAC |

TABLE 7D-continued

SIRs Targeting Different Antigens On SIR1-Type Backbone

| TARGET | CLONE ID | SEQ ID-DNA | SEQ ID-PRT | NAME |
|---|---|---|---|---|
| FLT3 | | 11318 | 13275 | CD8SP-FLT3-8B5-vL-PG4SP-v2-[hTCRb-KACIAH]-F-P2A-SP-FLT3-8B5-vH-PG4SP-[hTCRa-CSDVP]-F-F2A-PAC |
| FLT3 | | 11319 | 13276 | CD8SP-FLT3-10E3-vL-[hTCRb-KACIAH]-F-P2A-SP-FLT3-10E3-vH-[hTCRa-CSDVP]-F-F2A-PAC |
| BCMA | | 11320 | 13277 | CD8SP-BCMA-AJ-vL-PG4SP-v2-[hTCRb-KACIAH]-F-P2A-SP-BCMA-AJ-vH-PG4SP-[hTCRa-CSDVP]-F-F2A-PAC |
| BCMA | | 11321 | 13278 | CD8SP-BCMA-FS-vL-[hTCRb-KACIAH]-F-P2A-SP-BCMA-FS-vH-[hTCRa-CSDVP]-F-F2A-PAC |
| BCMA | | 11322 | 13279 | CD8SP-BCMA-NM-vL-PG4SP-v2-[hTCRb-KACIAH]-F-P2A-SP-BCMA-NM-vH-PG4SP-[hTCRa-CSDVP]-F-F2A-PAC |
| BCMA | | 11323 | 13280 | CD8SP-BCMA-PC-vL-[hTCRb-KACIAH]-F-P2A-SP-BCMA-PC-vH-[hTCRa-CSDVP]-F-F2A-PAC |
| BCMA | | 11324 | 13281 | CD8SP-BCMA-PP-vL-[hTCRb-KACIAH]-F-P2A-SP-BCMA-PP-vH-[hTCRa-CSDVP]-F-F2A-PAC |
| BCMA | | 11325 | 13282 | CD8SP-BCMA-RD-vL-PG4SP-v2-[hTCRb-KACIAH]-F-P2A-SP-BCMA-RD-vH-PG4SP-[hTCRa-CSDVP]-F-F2A-PAC |
| BCMA | | 11326 | 13283 | CD8SP-BCMA-TS-vL-[hTCRb-KACIAH]-F-P2A-SP-BCMA-TS-vH-[hTCRa-CSDVP]-F-F2A-PAC |
| BCMA | | 11327 | 13284 | CD8SP-BCMA-BB-CAR02-vL-PG4SP-v2-[hTCRb-KACIAH]-F-P2A-SP-BCMA-BB-CAR02-vH-PG4SP-[hTCRa-CSDVP]-F-F2A-PAC |
| CLL1 | | 11328 | 13285 | CD8SP-CLL1-24C1-vL-PG4SP-v2-[hTCRb-KACIAH]-F-P2A-SP-CLL1-24C1-vH-PG4SP-[hTCRa-CSDVP]-F-F2A-PAC |
| CLL1 | | 11329 | 13286 | CD8SP-CLL1-24C8-vL-PG4SP-v2-[hTCRb-KACIAH]-F-P2A-SP-CLL1-24C8-vH-PG4SP-[hTCRa-CSDVP]-F-F2A-PAC |
| Mesothelin | | 11330 | 13287 | CD8SP-MSLN-7D9-v3-vL-PG4SP-v2-[hTCRb-KACIAH]-F-P2A-SP-MSLN-7D9-v3-vH-PG4SP-[hTCRa-CSDVP]-F-F2A-PAC |
| Mesothelin | | 11331 | 13288 | CD8SP-MSLN-hu22A10-vL-[hTCRb-KACIAH]-F-P2A-SP-MSLN-hu22A10-vH-[hTCRa-CSDVP]-F-F2A-PAC |
| CD19 | | 11332 | 13289 | CD8SP-hu-Bu13-vL-PG4SP-v2-[hTCRb-KACIAH]-F-P2A-SP-hu-Bu13-vH-PG4SP-[hTCRa-CSDVP]-F-F2A-PAC |
| BST1/CD157 | | 11333 | 13290 | CD8SP-hu-BST1-A1-vL-V5-[hTCRb-KACIAH]-F-P2A-SP-hu-BST1-A1-vH-Myc-[hTCRa-CSDVP]-F-F2A-PAC |
| BST1/CD157 | | 11334 | 13291 | CD8SP-hu-BST1-A2-vL-V5-[hTCRb-KACIAH]-F-P2A-SP-hu-BST1-A2-vH-Myc-[hTCRa-CSDVP]-F-F2A-PAC |
| BST1/CD157 | | 11335 | 13292 | CD8SP-hu-BST1-A3-vL-V5-[hTCRb-KACIAH]-F-P2A-SP-hu-BST1-A3-vH-Myc-[hTCRa-CSDVP]-F-F2A-PAC |

TABLE 7E

SIRs Targeting Different Antigens on SIR10-Type Backbone

| TARGET | CLONE ID | SEQ ID-DNA | SEQ ID-PRT | NAME |
|---|---|---|---|---|
| CD19 | 082815-G07, 010616-Y05 | 1620 | 3855 | CD8SP-V5-[hTCRb-KACIAH]-F-P2A-CD8SP-FMC63-vL-Gly-Ser-Linker-FMC63-vH-Myc-[hTCRa-CSDVP]-F-F2A-PAC |
| CD19 | 091216-K03 | 1621 | 3856 | CD8SP-V5-[hTCRb-KACIAH]-F-P2A-CD8SP-huFMC63-11-vL-Gly-Ser-Linker-huFMC63-11-vH-Myc-[hTCRa-CSDVP]-F-F2A-PAC |

TABLE 7E-continued

SIRs Targeting Different Antigens on SIR10-Type Backbone

| TARGET | CLONE ID | SEQ ID-DNA | SEQ ID-PRT | NAME |
|---|---|---|---|---|
| CD19 | 082815-E05, 010616-W07 | 1622 | 3857 | CD8SP-V5-[hTCRb-KACIAH]-F-P2A-CD8SP-CD19Bu12-vL-Gly-Ser-Linker-CD19Bu12-vH-Myc-[hTCRa-CSDVP]-F-F2A-PAC |
| CD19 | 082815-F06, 031616-A05 | 1623 | 3858 | CD8SP-V5-[hTCRb-KACIAH]-F-P2A-CD8SP-2-CD19MM-vL-Gly-Ser-Linker-CD19MM-vH-Myc-[hTCRa-CSDVP]-F-F2A-PAC |
| CD19 | | 1624 | 3859 | CD8SP-V5-[hTCRb-KACIAH]-F-P2A-CD8SP-CD19-4G7-vL-Gly-Ser-Linker-CD19-4G7-vH-Myc-[hTCRa-CSDVP]-F-F2A-PAC |
| HIV1-env | | 1625 | 3860 | CD8SP-V5-[hTCRb-KACIAH]-F-P2A-CD8SP-HIV1-N6-vL-Gly-Ser-Linker-HIV1-N6-vH-Myc-[hTCRa-CSDVP]-F-F2A-PAC |
| ALK | 042916-C05 | 1626 | 3861 | CD8SP-V5-[hTCRb-KACIAH]-F-P2A-CD8SP-Alk-48-vL-Gly-Ser-Linker-Alk-48-vH-Myc-[hTCRa-CSDVP]-F-F2A-PAC |
| ALK | 042916-D02 | 1627 | 3862 | CD8SP-V5-[hTCRb-KACIAH]-F-P2A-CD8SP-Alk-58-vL-Gly-Ser-Linker-Alk-58-vH-Myc-[hTCRa-CSDVP]-F-F2A-PAC |
| Amyloid | 102116-G03 | 1628 | 3863 | CD8SP-V5-[hTCRb-KACIAH]-F-P2A-SP-Amyloid-15 8-vL-Gly-Ser-Linker-Amyloid-158-vH-Myc-[hTCRa-CSDVP]-F-F2A-PAC |
| Biotin | | 1629 | 3864 | CD8SP-V5-[hTCRb-KACIAH]-F-P2A-CD8SP-dc-Avidin-Myc-[hTCRa-CSDVP]-F-F2A-PAC |
| CD45 | | 1630 | 3865 | CD8SP-V5-[hTCRb-KACIAH]-F-P2A-CD8SP-BC8-CD45-vL-Gly-Ser-Linker-BC8-CD45-vH-Myc-[hTCRa-CSDVP]-F-F2A-PAC |
| BCMA | | 1631 | 3866 | CD8SP-V5-[hTCRb-KACIAH]-F-P2A-CD8SP-BCMA-J6M0-vL-Gly-Ser-Linker-BCMA-J6M0-vH-Myc-[hTCRa-CSDVP]-F-F2A-PAC |
| BCMA | | 1632 | 3867 | CD8SP-V5-[hTCRb-KACIAH]-F-P2A-CD8SP-BCMA-huC12A3-L3H3-vL-Gly-Ser-Linker-BCMA-huC12A3-L3H3-vH-Myc-[hTCRa-CSDVP]-F-F2A-PAC |
| BCMA | 102116-C06 | 1633 | 3868 | CD8SP-V5-[hTCRb-KACIAH]-F-P2A-CD8SP-BCMA-ET-40-vL-Gly-Ser-Linker-BCMA-ET-40-vH-Myc-[hTCRa-CSDVP]-F-F2A-PAC |
| BCMA | 102116-D01 | 1634 | 3869 | CD8SP-V5-[hTCRb-KACIAH]-F-P2A-CD8SP-BCMA-ET-54-vL-Gly-Ser-Linker-BCMA-ET-54-vH-Myc-[hTCRa-CSDVP]-F-F2A-PAC |
| CCR4 | | 1635 | 3870 | CD8SP-V5-[hTCRb-KACIAH]-F-P2A-CD8SP-CCR4-humAb1567-vL-Gly-Ser-Linker-CCR4-humAb1567-vH-Myc-[hTCRa-CSDVP]-F-F2A-PAC |
| HIV1-env | | 1636 | 3871 | CD8SP-V5-[hTCRb-KACIAH]-F-P2A-CD8SP-CD4-ECD-Gly-Ser-Linker-DC-SIGN-Myc-[hTCRa-CSDVP]-F-F2A-PAC |
| CD5 | 031616-B04 | 1637 | 3872 | CD8SP-V5-[hTCRb-KACIAH]-F-P2A-CD8SP-CD5-9-vL-Gly-Ser-Linker-CD5-9-vH-Myc-[hTCRa-CSDVP]-F-F2A-PAC |
| CD5 | 031616-A02 | 1638 | 3873 | CD8SP-V5-[hTCRb-KACIAH]-F-P2A-CD8SP-CD5-18-vL-Gly-Ser-Linker-CD5-18-vH-Myc-[hTCRa-CSDVP]-F-F2A-PAC |
| Ig Fc | | 1639 | 3874 | CD8SP-V5-[hTCRb-KACIAH]-F-P2A-CD8SP-CD16A-v158-v2-Myc-[hTCRa-CSDVP]-F-F2A-PAC |
| Ig Fc | | 1640 | 3875 | CD8SP-V5-[hTCRb-KACIAH]-F-P2A-CD8SP-CD16A-V158-v1-Myc-[hTCRa-CSDVP]-F-F2A-PAC |
| CD20 | | 1641 | 3876 | CD8SP-V5-[hTCRb-KACIAH]-F-P2A-CD8SP-CD20-2F2-vL-Gly-Ser-Linker-CD20-2F2-vH-Myc-[hTCRa-CSDVP]-F-F2A-PAC |
| CD20 | 090116-B02 | 1642 | 3877 | CD8SP-V5-[hTCRb-KACIAH]-F-P2A-CD8SP-CD20-GA101-vL-Gly-Ser-Linker-CD20-GA101-vH-Myc-[hTCRa-CSDVP]-F-F2A-PAC |
| CD22 | 091216-A03 | 1643 | 3878 | CD8SP-V5-[hTCRb-KACIAH]-F-P2A-CD8SP-CD22-h10F4v2-vL-Gly-Ser-Linker-CD22-h10F4v2-vH-Myc-[hTCRa-CSDVP]-F-F2A-PAC |
| CD22 | 042816-H07 | 1644 | 3879 | CD8SP-V5-[hTCRb-KACIAH]-F-P2A-CD8SP-CD22-H22Rhov2ACDRKA-vL-Gly-Ser-Linker-CD22-H22Rhov2ACDRKA-vH-Myc-[hTCRa-CSDVP]-F-F2A-PAC |

TABLE 7E-continued

SIRs Targeting Different Antigens on SIR10-Type Backbone

| TARGET | CLONE ID | SEQ ID-DNA | SEQ ID-PRT | NAME |
|---|---|---|---|---|
| CD22 | 092216-C04 | 1645 | 3880 | CD8SP-V5-[hTCRb-KACIAH]-F-P2A-CD8SP-CD22-m971-vL-Gly-Ser-Linker-CD22-m971-vH-Myc-[hTCRa-CSDVP]-F-F2A-PAC |
| CD30 | 091316-D03 | 1646 | 3881 | CD8SP-V5-[hTCRb-KACIAH]-F-P2A-CD8SP-CD30-5F11-vL-Gly-Ser-Linker-CD30-5F11-vH-Myc-[hTCRa-CSDVP]-F-F2A-PAC |
| CD30 | | 1647 | 3882 | CD8SP-V5-[hTCRb-KACIAH]-F-P2A-CD8SP-CD30-Ac10-vL-Gly-Ser-Linker-CD30-Ac10-vH-Myc-[hTCRa-CSDVP]-F-F2A-PAC |
| CD32 | | 1648 | 3883 | CD8SP-V5-[hTCRb-KACIAH]-F-P2A-CD8SP-CD32-Med9-vL-Gly-Ser-Linker-CD32-Med9-vH-Myc-[hTCRa-CSDVP]-F-F2A-PAC |
| CD33 | 090116-F02 | 1649 | 3884 | CD8SP-V5-[hTCRb-KACIAH]-F-P2A-CD8SP-CD33-AF5-vL-Gly-Ser-Linker-CD33-AF5-vH-Myc-[hTCRa-CSDVP]-F-F2A-PAC |
| CD33 | 090116-C02 | 1650 | 3885 | CD8SP-V5-[hTCRb-KACIAH]-F-P2A-CD8SP-CD33-huMyc9-vL-Gly-Ser-Linker-CD33-huMyc9-vH-Myc-[hTCRa-CSDVP]-F-F2A-PAC |
| CD34 | 051016-B05 | 1651 | 3886 | CD8SP-V5-[hTCRb-KACIAH]-F-P2A-CD8SP-CD34-hu4C7-vL-Gly-Ser-Linker-CD34-hu4C7-vH-Myc-[hTCRa-CSDVP]-F-F2A-PAC |
| CD44v6 | 021616-I03 | 1652 | 3887 | CD8SP-V5-[hTCRb-KACIAH]-F-P2A-CD8SP-CD4 4v6-Biwa8-vL-Gly-Ser-Linker-CD44v6-Biwa8-vH-Myc-[hTCRa-CSDVP]-F-F2A-PAC |
| CD70 | 030216-B02 | 1653 | 3888 | CD8SP-V5-[hTCRb-KACIAH]-F-P2A-CD8SP-CD70-h1F6-vL-Gly-Ser-Linker-CD70-h1F6-vH-Myc-[hTCRa-CSDVP]-F-F2A-PAC |
| CD79b | 090116-G02 | 1654 | 3889 | CD8SP-V5-[hTCRb-KACIAH]-F-P2A-CD8SP-CD79b-2F2-vL-Gly-Ser-Linker-CD79b-2F2-vH-Myc-[hTCRa-CSDVP]-F-F2A-PAC |
| CD123 | 090116-I01 | 1655 | 3890 | CD8SP-V5-[hTCRb-KACIAH]-F-P2A-CD8SP-CD123-CSL362-vL-Gly-Ser-Linker-CD123-CSL362-vH-Myc-[hTCRa-CSDVP]-F-F2A-PAC |
| CD138 | 090116-H02 | 1656 | 3891 | CD8SP-V5-[hTCRb-KACIAH]-F-P2A-CD8SP-CD138-vL-Gly-Ser-Linker-CD138-vH-Myc-[hTCRa-CSDVP]-F-F2A-PAC |
| CD179b | | 1657 | 3892 | CD8SP-V5-[hTCRb-KACIAH]-F-P2A-CD8SP-CD179b-vL-Gly-Ser-Linker-CD179b-vH-Myc-[hTCRa-CSDVP]-F-F2A-PAC |
| CD276 | 042816-C03 | 1658 | 3893 | CD8SP-V5-[hTCRb-KACIAH]-F-P2A-CD8SP-CD276-17-vL-Gly-Ser-Linker-CD276-17-vH-Myc-[hTCRa-CSDVP]-F-F2A-PAC |
| CD324 | | 1659 | 3894 | CD8SP-V5-[hTCRb-KACIAH]-F-P2A-CD8SP-CD324-SC10-6-vL-Gly-Ser-Linker-CD324-SC10-6-vH-Myc-[hTCRa-CSDVP]-F-F2A-PAC |
| CD324 | | 1660 | 3895 | CD8SP-V5-[hTCRb-KACIAH]-F-P2A-CD8SP-CD324-hSC10-17-vL-Gly-Ser-Linker-CD324-hSC10-17-vH-Myc-[hTCRa-CSDVP]-F-F2A-PAC |
| CDH6 | | 1661 | 3896 | CD8SP-V5-[hTCRb-KACIAH]-F-P2A-CD8SP-CDH6-NOV710-vL-Gly-Ser-Linker-CDH6-NOV710-vH-Myc-[hTCRa-CSDVP]-F-F2A-PAC |
| CDH6 | | 1662 | 3897 | CD8SP-V5-[hTCRb-KACIAH]-F-P2A-CD8SP-CDH6-NOV712-vL-Gly-Ser-Linker-CDH6-NOV712-vH-Myc-[hTCRa-CSDVP]-F-F2A-PAC |
| CDH17 | | 1663 | 3898 | CD8SP-V5-[hTCRb-KACIAH]-F-P2A-CD8SP-CDH17-PTA001A4-vL-Gly-Ser-Linker-CDH17-PTA001A4-vH-Myc-[hTCRa-CSDVP]-F-F2A-PAC |
| CDH19 | | 1664 | 3899 | CD8SP-V5-[hTCRb-KACIAH]-F-P2A-CD8SP-CDH19-16A4-vL-Gly-Ser-Linker-CDH19-16A4-vH-Myc-[hTCRa-CSDVP]-F-F2A-PAC |
| EGFR | | 1665 | 3900 | CD8SP-V5-[hTCRb-KACIAH]-F-P2A-CD8SP-Cetuximab-vL-Gly-Ser-Linker-Cetuximab-vH-Myc-[hTCRa-CSDVP]-F-F2A-PAC |
| CLEC5A | 042816-E05 | 1666 | 3901 | CD8SP-V5-[hTCRb-KACIAH]-F-P2A-CD8SP-CLEC5A-8H8F5-vL-Gly-Ser-Linker-CLEC5A-8H8F5-vH-Myc-[hTCRa-CSDVP]-F-F2A-PAC |

TABLE 7E-continued

SIRs Targeting Different Antigens on SIR10-Type Backbone

| TARGET | CLONE ID | SEQ ID-DNA | SEQ ID-PRT | NAME |
|---|---|---|---|---|
| CLEC5A | 042816-G04 | 1667 | 3902 | CD8SP-V5-[hTCRb-KACIAH]-F-P2A-CD8SP-CLEC5A-3E12A2-vL-Gly-Ser-Linker-CLEC5A-3E12A2-vH-Myc-[hTCRa-CSDVP]-F-F2A-PAC |
| GR/LHR | 091616-U01 | 1668 | 3903 | CD8SP-V5-[hTCRb-KACIAH]-F-P2A-SP-CGHb-Gly-Ser-Linker-CGHa-Myc-[hTCRa-CSDVP]-F-F2A-PAC |
| CLL1 | 092216-G01 | 1669 | 3904 | CD8SP-V5-[hTCRb-KACIAH]-F-P2A-CD8SP-CLL1-M26-vL-Gly-Ser-Linker-CLL1-M26-vH-Myc-[hTCRa-CSDVP]-F-F2A-PAC |
| CLL1 | 092216-H05 | 1670 | 3905 | CD8SP-V5-[hTCRb-KACIAH]-F-P2A-CD8SP-CLL1-M32-vL-Gly-Ser-Linker-CLL1-M32-vH-Myc-[hTCRa-CSDVP]-F-F2A-PAC |
| CMVpp65 | | 1671 | 3906 | CD8SP-V5-[hTCRb-KACIAH]-F-P2A-CD8SP-CMVpp65-F5-vL-Gly-Ser-Linker-CMVpp65-F5-vH-Myc-[hTCRa-CSDVP]-F-F2A-PAC |
| CS1 | | 1672 | 3907 | CD8SP-V5-[hTCRb-KACIAH]-F-P2A-CD8SP-CS1-huLuc63-vL-Gly-Ser-Linker-CS1-huLuc63-vH-Myc-[hTCRa-CSDVP]-F-F2A-PAC |
| CS1 | 091216-L03 | 1673 | 3908 | CD8SP-V5-[hTCRb-KACIAH]-F-P2A-CD8SP-CS1-HuLuc64-vL-Gly-Ser-Linker-CS1-HuLuc64-vH-Myc-[hTCRa-CSDVP]-F-F2A-PAC |
| CS1 | 090116-L01 | 1674 | 3909 | CD8SP-V5-[hTCRb-KACIAH]-F-P2A-CD8SP-CS1-huLuc90-vL-Gly-Ser-Linker-CS1-huLuc90-vH-Myc-[hTCRa-CSDVP]-F-F2A-PAC |
| CSF2RA | 051016-A08 | 1675 | 3910 | CD8SP-V5-[hTCRb-KACIAH]-F-P2A-CD8SP-CSF2RA-Ab6-vL-Gly-Ser-Linker-CSF2RA-Ab6-vH-Myc-[hTCRa-CSDVP]-F-F2A-PAC |
| CSF2RA | 050216-B02 | 1676 | 3911 | CD8SP-V5-[hTCRb-KACIAH]-F-P2A-CD8SP-CSF2RA-Ab1-vL-Gly-Ser-Linker-CSF2RA-Ab1-vH-Myc-[hTCRa-CSDVP]-F-F2A-PAC |
| CXCR4 and CD123 | | 1677 | 3912 | CD8SP-V5-[hTCRb-KACIAH]-F-P2A-CD8SP-CXCR4-1-vHH-Gly-Ser-Linker-CD123-1-vHH-Myc-[hTCRa-CSDVP]-F-F2A-PAC |
| CXCR4 and CD123 | | 1678 | 3913 | CD8SP-V5-[hTCRb-KACIAH]-F-P2A-CD8SP-CXCR4-2-vHH-Gly-Ser-Linker-CD123-2-vHH-Myc-[hTCRa-CSDVP]-F-F2A-PAC |
| DLL3 | | 1679 | 3914 | CD8SP-V5-[hTCRb-KACIAH]-F-P2A-CD8SP-DLL3-hSC16-13-vL-Gly-Ser-Linker-DLL3-hSC16-13-vH-Myc-[hTCRa-CSDVP]-F-F2A-PAC |
| DLL3 | | 1680 | 3915 | CD8SP-V5-[hTCRb-KACIAH]-F-P2A-CD8SP-DLL3-hSC16-56-vL-Gly-Ser-Linker-DLL3-hSC16-56-vH-Myc-[hTCRa-CSDVP]-F-F2A-PAC |
| EBNA3c | | 1681 | 3916 | CD8SP-V5-[hTCRb-KACIAH]-F-P2A-CD8SP-EBNA3c-315-vL-Gly-Ser-Linker-EBNA3c-315-vH-Myc-[hTCRa-CSDVP]-F-F2A-PAC |
| EBV-gp350 | | 1682 | 3917 | CD8SP-V5-[hTCRb-KACIAH]-F-P2A-CD8SP-EBV-gp350-vL-Gly-Ser-Linker-EBV-gp350-vH-Myc-[hTCRa-CSDVP]-F-F2A-PAC |
| EGFR | | 1683 | 3918 | CD8SP-V5-[hTCRb-KACIAH]-F-P2A-CD8SP-EGFR1-vHH-Myc-[hTCRa-CSDVP]-F-F2A-PAC |
| EGFR | 040716-C05 | 1684 | 3919 | CD8SP-V5-[hTCRb-KACIAH]-F-P2A-CD8SP-EGFR1-vHH-Gly-Ser-Linker-CEA1-vHH-Myc-[hTCRa-CSDVP]-F-F2A-PAC |
| EGFR | 040716-D06 | 1685 | 3920 | CD8SP-V5-[hTCRb-KACIAH]-F-P2A-CD8SP-EGFR33-vHH-Gly-Ser-Linker-CEA5-vHH-Myc-[hTCRa-CSDVP]-F-F2A-PAC |
| EGFRvIII | 092216-I06 | 1686 | 3921 | CD8SP-V5-[hTCRb-KACIAH]-F-P2A-CD8SP-EGFRvIII-139-vL-Gly-Ser-Linker-EGFRvIII-139-vH-Myc-[hTCRa-CSDVP]-F-F2A-PAC |
| EGFRvIII | 092216-J01 | 1687 | 3922 | CD8SP-V5-[hTCRb-KACIAH]-F-P2A-CD8SP-EGFRvIII-2173-vH-Gly-Ser-Linker-EGFRvIII-2173-vH-Myc-[hTCRa-CSDVP]-F-F2A-PAC |
| EpCam1 | | 1688 | 3923 | CD8SP-V5-[hTCRb-KACIAH]-F-P2A-CD8SP-Epcam1-MM1-vL-Gly-Ser-Linker-Epcam1-MM1-vH-Myc-[hTCRa-CSDVP]-F-F2A-PAC |

TABLE 7E-continued

SIRs Targeting Different Antigens on SIR10-Type Backbone

| TARGET | CLONE ID | SEQ ID-DNA | SEQ ID-PRT | NAME |
|---|---|---|---|---|
| EpCam1 | | 1689 | 3924 | CD8SP-V5-[hTCRb-KACIAH]-F-P2A-CD8SP-Epcam1-D5K5-vL-Gly-Ser-Linker-Epcam1-D5K5-vH-Myc-[hTCRa-CSDVP]-F-F2A-PAC |
| FLT3 | | 1690 | 3925 | CD8SP-V5-[hTCRb-KACIAH]-F-P2A-CD8SP-FLT3-NC7-vL-Gly-Ser-Linker-FLT3-NC7-vH-Myc-[hTCRa-CSDVP]-F-F2A-PAC |
| FITC | 042816-B02 | 1691 | 3926 | CD8SP-V5-[hTCRb-KACIAH]-F-P2A-CD8SP-FITC-vL-Gly-Ser-Linker-FITC-vH-Myc-[hTCRa-CSDVP]-F-F2A-PAC |
| Influenza A HA | 102116-B04 | 1692 | 3927 | CD8SP-V5-[hTCRb-KACIAH]-F-P2A-CD8SP-FLU-MEDI-8852-vL-Gly-Ser-Linker-FLU-MEDI-8852-vH-Myc-[hTCRa-CSDVP]-F-F2A-PAC |
| FR1 (Folate Receptor a) | | 1693 | 3928 | CD8SP-V5-[hTCRb-KACIAH]-F-P2A-CD8SP-FR1-huMov19-vL-Gly-Ser-Linker-FR1-huMov19-vH-Myc-[hTCRa-CSDVP]-F-F2A-PAC |
| FSHR | 091516-L06 | 1694 | 3929 | CD8SP-V5-[hTCRb-KACIAH]-F-P2A-CD8SP-FSHb-Gly-Ser-Linker-CGHa-Myc-[hTCRa-CSDVP]-F-F2A-PAC |
| GD2 | | 1695 | 3930 | CD8SP-V5-[hTCRb-KACIAH]-F-P2A-CD8SP-GD2-hu14-18-vL-Gly-Ser-Linker-GD2-hu14-18-vH-Myc-[hTCRa-CSDVP]-F-F2A-PAC |
| GD2 | | 1696 | 3931 | CD8SP-V5-[hTCRb-KACIAH]-F-P2A-CD8SP-GD2-hu3F8-vL-Gly-Ser-Linker-GD2-hu3F8-vH-Myc-[hTCRa-CSDVP]-F-F2A-PAC |
| GD3 | 042816-A04 | 1697 | 3932 | CD8SP-V5-[hTCRb-KACIAH]-F-P2A-CD8SP-GD3-KM-641-vL-Gly-Ser-Linker-GD3-KM-641-vH-Myc-[hTCRa-CSDVP]-F-F2A-PAC |
| GFRa4 | | 1698 | 3933 | CD8SP-V5-[hTCRb-KACIAH]-F-P2A-CD8SP-GFRA1pha4-P4-6-vL-Gly-Ser-Linker-GFRA1pha4-P4-6-vH-Myc-[hTCRa-CSDVP]-F-F2A-PAC |
| GFRa4 | | 1699 | 3934 | CD8SP-V5-[hTCRb-KACIAH]-F-P2A-CD8SP-GFRa4-P4-10-vL-Gly-Ser-Linker-GFRa4-P4-10-vH-Myc-[hTCRa-CSDVP]-F-F2A-PAC |
| FUCOSYL-GM1 | | 1700 | 3935 | CD8SP-V5-[hTCRb-KACIAH]-F-P2A-CD8SP-GM1-5B2-vL-Gly-Ser-Linker-GM1-5B2-vH-Myc-[hTCRa-CSDVP]-F-F2A-PAC |
| FUCOSYL-GM1 | | 1701 | 3936 | CD8SP-V5-[hTCRb-KACIAH]-F-P2A-CD8SP-GM1-7E5-vL-Gly-Ser-Linker-GM1-7E5-vH-Myc-[hTCRa-CSDVP]-F-F2A-PAC |
| GPRC5D | 102116-E03 | 1702 | 3937 | CD8SP-V5-[hTCRb-KACIAH]-F-P2A-CD8SP-GPRC5D-ET150-5-vL-Gly-Ser-Linker-GPRC5D-ET150-5-vH-Myc-[hTCRa-CSDVP]-F-F2A-PAC |
| GPRC5D | 102116-F07 | 1703 | 3938 | CD8SP-V5-[hTCRb-KACIAH]-F-P2A-CD8SP-GPRC5D-ET150-18-vL-Gly-Ser-Linker-GPRC5D-ET150-18-vH-Myc-[hTCRa-CSDVP]-F-F2A-PAC |
| gp100 | 021616-F03 | 1704 | 3939 | CD8SP-V5-[hTCRb-KACIAH]-F-P2A-CD8SP-gp100-vL-Gly-Ser-Linker-gp100-vH-Myc-[hTCRa-CSDVP]-F-F2A-PAC |
| gp100 | | 1705 | 3940 | CD8SP-V5-[hTCRb-KACIAH]-F-P2A-CD8SP-gp100-G2D12-vL-Gly-Ser-Linker-gp100-G2D12-vH-Myc-[hTCRa-CSDVP]-F-F2A-PAC |
| GPC3 | | 1706 | 3941 | CD8SP-V5-[hTCRb-KACIAH]-F-P2A-CD8SP-GPC3-4E5-vL-Gly-Ser-Linker-GPC3-4E5-vH-Myc-[hTCRa-CSDVP]-F-F2A-PAC |
| gpNMB | | 1707 | 3942 | CD8SP-V5-[hTCRb-KACIAH]-F-P2A-CD8SP-gpNMB-115-vL-Gly-Ser-Linker-gpNMB-115-vH-Myc-[hTCRa-CSDVP]-F-F2A-PAC |
| GRP78 | | 1708 | 3943 | CD8SP-V5-[hTCRb-KACIAH]-F-P2A-CD8SP-GRP78-GC18-vL-Gly-Ser-Linker-GRP78-GC18-vH-Myc-[hTCRa-CSDVP]-F-F2A-PAC |
| Her2 | | 1709 | 3944 | CD8SP-V5-[hTCRb-KACIAH]-F-P2A-CD8SP-Her2-5F7-vHH-Myc-[hTCRa-CSDVP]-F-F2A-PAC |
| Her2 | | 1710 | 3945 | CD8SP-V5-[hTCRb-KACIAH]-F-P2A-IgHSP-Her2-Affi-Myc-[hTCRa-CSDVP]-F-F2A-PAC |
| Her2 | | 1711 | 3946 | CD8SP-V5-[hTCRb-KACIAH]-F-P2A-CD8SP-Her2-1-Darpin-Myc-[hTCRa-CSDVP]-F-F2A-PAC |

TABLE 7E-continued

SIRs Targeting Different Antigens on SIR10-Type Backbone

| TARGET | CLONE ID | SEQ ID-DNA | SEQ ID-PRT | NAME |
|---|---|---|---|---|
| Her2 | | 1712 | 3947 | CD8SP-V5-[hTCRb-KACIAH]-F-P2A-IgHSP-Her2-2-Darpin-Myc-[hTCRa-CSDVP]-F-F2A-PAC |
| Her2 | 040716-E02 | 1713 | 3948 | CD8SP-V5-[hTCRb-KACIAH]-F-P2A-CD8SP-Her2-5F7-vHH-Gly-Ser-Linker-Her2-47D5-vHH-Myc-[hTCRa-CSDVP]-F-F2A-PAC |
| Her2 | 042816-105 | 1714 | 3949 | CD8SP-V5-[hTCRb-KACIAH]-F-P2A-CD8SP-Her2-Hu4D5-vL-Gly-Ser-Linker-Her2-Hu4D5-vH-Myc-[hTCRa-CSDVP]-F-F2A-PAC |
| Her3 | | 1715 | 3950 | CD8SP-V5-[hTCRb-KACIAH]-F-P2A-CD8SP-Her3-17B05So-vHH-Myc-[hTCRa-CSDVP]-F-F2A-PAC |
| Her3 | | 1716 | 3951 | CD8SP-V5-[hTCRb-KACIAH]-F-P2A-CD8SP-Her3-Affi-Myc-[hTCRa-CSDVP]-F-F2A-PAC |
| Her2 and Her3 | 040716-B03 | 1717 | 3952 | CD8SP-V5-[hTCRb-KACIAH]-F-P2A-CD8SP-Her3-17B05So-vHH-Gly-Ser-Linker-Her2-2D3-vHH-Myc-[hTCRa-CSDVP]-F-F2A-PAC |
| HIV1-gag | 021616-U03 | 1718 | 3953 | CD8SP-V5-[hTCRb-KACIAH]-F-P2A-CD8SP-HIV1-E5-vL-Gly-Ser-Linker-HIV1-E5-vH-Myc-[hTCRa-CSDVP]-F-F2A-PAC |
| HIV1-env | | 1719 | 3954 | CD8SP-V5-[hTCRb-KACIAH]-F-P2A-CD8SP-HIV1-3BNC117-vL-Gly-Ser-Linker-HIV1-3BNC117-vH-Myc-[hTCRa-CSDVP]-F-F2A-PAC |
| HIV1-env | | 1720 | 3955 | CD8SP-V5-[hTCRb-KACIAH]-F-P2A-CD8SP-HIV1-PGT-128-vL-Gly-Ser-Linker-vH-Myc-[hTCRa-CSDVP]-F-F2A-PAC |
| HIV1-env | | 1721 | 3956 | CD8SP-V5-[hTCRb-KACIAH]-F-P2A-CD8SP-HIV1-VR-C01-vL-Gly-Ser-Linker-HIV1-VR-C01-vH-Myc-[hTCRa-CSDVP]-F-F2A-PAC |
| HIV1-env | | 1722 | 3957 | CD8SP-V5-[hTCRb-KACIAH]-F-P2A-CD8SP-HIV1-X5-vL-Gly-Ser-Linker-HIV1-X5-vH-Myc-[hTCRa-CSDVP]-F-F2A-PAC |
| HMW-MAA | 051016-C02 | 1723 | 3958 | CD8SP-V5-[hTCRb-KACIAH]-F-P2A-CD8SP-HMW-MAA-h1ND-vL-Gly-Ser-Linker-HMW-MAA-h1ND-vH-Myc-[hTCRa-CSDVP]-F-F2A-PAC |
| HTLV1-TAX | | 1724 | 3959 | CD8SP-V5-[hTCRb-KACIAH]-F-P2A-CD8SP-HTLV-TAX-T3F2-vL-Gly-Ser-Linker-TAX-T3F2-vH-Myc-[hTCRa-CSDVP]-F-F2A-PAC |
| HTLV1-TAX | 021716-D07 | 1725 | 3960 | CD8SP-V5-[hTCRb-KACIAH]-F-P2A-CD8SP-HTLV-TAX-T3E3-vL-Gly-Ser-Linker-TAX-T3E3-vH-Myc-[hTCRa-CSDVP]-F-F2A-PAC |
| IL11Ra | 042816-D05 | 1726 | 3961 | CD8SP-V5-[hTCRb-KACIAH]-F-P2A-CD8SP-IL11Ra-8E2-Ts107-vL-Gly-Ser-Linker-IL11Ra-8E2-Ts107-vH-Myc-[hTCRa-CSDVP]-F-F2A-PAC |
| IL6Ra | | 1727 | 3962 | CD8SP-V5-[hTCRb-KACIAH]-F-P2A-IgHSP-IL6R-304-vHH-Myc-[hTCRa-CSDVP]-F-F2A-PAC |
| IL13Ra2 | 042916-B04 | 1728 | 3963 | CD8SP-V5-[hTCRb-KACIAH]-F-P2A-CD8SP-IL13Ra2-hu107-vL-Gly-Ser-Linker-IL13Ra2-hu107vH-Myc-[hTCRa-CSDVP]-F-F2A-PAC |
| IL13Ra2 | 042816-F01 | 1729 | 3964 | CD8SP-V5-[hTCRb-KACIAH]-F-P2A-CD8SP-IL13Ra2-Hu108-vL-Gly-Ser-Linker-IL13Ra2-Hu108-vH-Myc-[hTCRa-CSDVP]-F-F2A-PAC |
| KSHV-K8.1 | 100615-G08 | 1730 | 3965 | CD8SP-V5-[hTCRb-KACIAH]-F-P2A-CD8SP-KSHV-4C3-vL-Gly-Ser-Linker-4C3-vH-Myc-[hTCRa-CSDVP]-F-F2A-PAC |
| LAMP1 | | 1731 | 3966 | CD8SP-V5-[hTCRb-KACIAH]-F-P2A-CD8SP-LAMP1-humab1-2-vL-Gly-Ser-Linker-LAMP1-humab1-2vH-Myc-[hTCRa-CSDVP]-F-F2A-PAC |
| LAMP1 | 050216-F05 | 1732 | 3967 | CD8SP-V5-[hTCRb-KACIAH]-F-P2A-CD8SP-LAMP1-Mb4-vL-Gly-Ser-Linker-LAMP1-Mb4-vH-Myc-[hTCRa-CSDVP]-F-F2A-PAC |
| LewisY | | 1733 | 3968 | CD8SP-V5-[hTCRb-KACIAH]-F-P2A-CD8SP-LewisY-huS193-vL-Gly-Ser-Linker-LewisY-huS193-vH-Myc-[hTCRa-CSDVP]-F-F2A-PAC |
| L1CAM | | 1734 | 3969 | CD8SP-V5-[hTCRb-KACIAH]-F-P2A-CD8SP-L1CAM-9-3-HU3-vL-Gly-Ser-Linker- |

TABLE 7E-continued

SIRs Targeting Different Antigens on SIR10-Type Backbone

| TARGET | CLONE ID | SEQ ID-DNA | SEQ ID-PRT | NAME |
|---|---|---|---|---|
| | | | | L1CAM-9-3-HU3-vH-Myc-[hTCRa-CSDVP]-F-F2A-PAC |
| LHR | 091616-R03 | 1735 | 3970 | CD8SP-V5-[hTCRb-KACIAH]-F-P2A-SP-LHb-Gly-Ser-Linker-CGHa-Myc-[hTCRa-CSDVP]-F-F2A-PAC |
| Lym1 | 090116-J01 | 1736 | 3971 | CD8SP-V5-[hTCRb-KACIAH]-F-P2A-CD8SP-Lym1-vL-Gly-Ser-Linker-Lym1-vH-Myc-[hTCRa-CSDVP]-F-F2A-PAC |
| Lym2 | 090116-K02 | 1737 | 3972 | CD8SP-V5-[hTCRb-KACIAH]-F-P2A-CD8SP-Lym2-vL-Gly-Ser-Linker-Lym2-vH-Myc-[hTCRa-CSDVP]-F-F2A-PAC |
| CD79b | | 1738 | 3973 | CD8SP-V5-[hTCRb-KACIAH]-F-P2A-CD8SP-huMA7 9bv2 8-vL-Gly-Ser-LinkeΓ-H uMA79bv2 8-vH-Myc-[hTCRa-CSDVP]-F-F2A-PAC |
| MART1/MHC | 021216-N03 | 1739 | 3974 | CD8SP-V5-[hTCRb-KACIAH]-F-P2A-CD8SP-MART1-CAG10-vL-Gly-Ser-Linker-MART1-CAG10-vH-Myc-[hTCRa-CSDVP]-F-F2A-PAC |
| MART1/MHC | 021616-O06 | 1740 | 3975 | CD8SP-V5-[hTCRb-KACIAH]-F-P2A-CD8SP-MART1-CLA12-vL-Gly-Ser-Linker-MART1-CLA12-vH-Myc-[hTCRa-CSDVP]-F-F2A-PAC |
| Mesothelin | 091216-G03 | 1741 | 3976 | CD8SP-V5-[hTCRb-KACIAH]-F-P2A-CD8SP-Mesothelin-m912-vL-Gly-Ser-Linker-m912-vH-Myc-[hTCRa-CSDVP]-F-F2A-PAC |
| cMet | | 1742 | 3977 | CD8SP-V5-[hTCRb-KACIAH]-F-P2A-CD8SP-cMet-171-vHH-Myc-[hTCRa-CSDVP]-F-F2A-PAC |
| cMet and Her3 | 040716-F04 | 1743 | 3978 | CD8SP-V5-[hTCRb-KACIAH]-F-P2A-CD8SP-cMET-171-vHH-Gly-Ser-Linker-Her3-21F06-vHH-Myc-[hTCRa-CSDVP]-F-F2A-PAC |
| MPL | 092216-B03 | 1744 | 3979 | CD8SP-V5-[hTCRb-KACIAH]-F-P2A-CD8SP-MPL-175-vL-Gly-Ser-Linker-175-vH-Myc-[hTCRa-CSDVP]-F-F2A-PAC |
| MPL | 092816-B01 | 1745 | 3980 | CD8SP-V5-[hTCRb-KACIAH]-F-P2A-CD8SP-MPL-161-vL-Gly-Ser-Linker-161-vH-Myc-[hTCRa-CSDVP]-F-F2A-PAC |
| MPL | 040716-A07 | 1746 | 3981 | CD8SP-V5-[hTCRb-KACIAH]-F-P2A-CD8SP-2-MPL-111-vL-Gly-Ser-Linker-MPL-111-vH-Myc-[hTCRa-CSDVP]-F-F2A-PAC |
| MPL | 091316-A01 | 1747 | 3982 | CD8SP-V5-[hTCRb-KACIAH]-F-P2A-CD8SP-MPL-178-vL-Gly-Ser-Linker-178-vH-Myc-[hTCRa-CSDVP]-F-F2A-PAC |
| MPL | | 1748 | 3983 | CD8SP-V5-[hTCRb-KACIAH]-F-P2A-CD8SP-MPL-AB317-vL-Gly-Ser-Linker-AB317-vH-Myc-[hTCRa-CSDVP]-F-F2A-PAC |
| MPL | | 1749 | 3984 | CD8SP-V5-[hTCRb-KACIAH]-F-P2A-CD8SP-MPL-12E10-vL-Gly-Ser-Linker-12E10-vH-Myc-[hTCRa-CSDVP]-F-F2A-PAC |
| MPL | | 1750 | 3985 | CD8SP-V5-[hTCRb-KACIAH]-F-P2A-CD8SP-MPL-huVB22Bw5-vL-Gly-Ser-Linker-huVB22Bw5-vH-Myc-[hTCRa-CSDVP]-F-F2A-PAC |
| Muc16 | 021616-B05 | 1751 | 3986 | CD8SP-V5-[hTCRb-KACIAH]-F-P2A-CD8SP-Muc1-D6-M3B8-vL-Gly-Ser-Linker-Muc1-D6-M3B8-vH-Myc-[hTCRa-CSDVP]-F-F2A-PAC |
| Muc16 | 021616-T03 | 1752 | 3987 | CD8SP-V5-[hTCRb-KACIAH]-F-P2A-CD8SP-MUC1-D6-M3A1-vL-Gly-Ser-Linker-MUC1-D6-M3A1-vH-Myc-[hTCRa-CSDVP]-F-F2A-PAC |
| Muc16 | | 1753 | 3988 | CD8SP-V5-[hTCRb-KACIAH]-F-P2A-CD8SP-Muc16-4H11-vL-Gly-Ser-Linker-Muc16-4H11-vH-Myc-[hTCRa-CSDVP]-F-F2A-PAC |
| EGFR | | 1754 | 3989 | CD8SP-V5-[hTCRb-KACIAH]-F-P2A-CD8SP-Nimotuzumab-vL-Gly-Ser-Linker-Nimotuzumab-vH-Myc-[hTCRa-CSDVP]-F-F2A-PAC |
| NKG2D Ligand | 042916-A06 | 1755 | 3990 | CD8SP-V5-[hTCRb-KACIAH]-F-P2A-CD8SP-NKG2D-(GGGGS-GGGGD)-Myc-[hTCRa-CSDVP]-F-F2A-PAC |
| NKG2D | | 1756 | 3991 | CD8SP-V5-[hTCRb-KACIAH]-F-P2A-CD8SP-NKG2D-MS-vL-Gly-Ser-Linker-NKG2D-MS-vH-Myc-[hTCRa-CSDVP]-F-F2A-PAC |

TABLE 7E-continued

SIRs Targeting Different Antigens on SIR10-Type Backbone

| TARGET | CLONE ID | SEQ ID-DNA | SEQ ID-PRT | NAME |
|---|---|---|---|---|
| NYBR1 | | 1757 | 3992 | CD8SP-V5-[hTCRb-KACIAH]-F-P2A-CD8SP-NYBR1-vL-Gly-Ser-Linker-NYBR1-vH-Myc-[hTCRa-CSDVP]-F-F2A-PAC |
| NY-ESO/MHC | 021616-V01 | 1758 | 3993 | CD8SP-V5-[hTCRb-KACIAH]-F-P2A-CD8SP-NYESO-T1-vL-Gly-Ser-Linker-NYESO-T1-vH-Myc-[hTCRa-CSDVP]-F-F2A-PAC |
| NY-ESO/MHC | | 1759 | 3994 | CD8SP-V5-[hTCRb-KACIAH]-F-P2A-CD8SP-NYESO-T1-vL-Gly-Ser-Linker-NYESO-T2-vH-Myc-[hTCRa-CSDVP]-F-F2A-PAC |
| PD1 ligand (e.g., PDL1) | | 1760 | 3995 | CD8SP-V5-[hTCRb-KACIAH]-F-P2A-CD8SP-PD1-ECD-Myc-[hTCRa-CSDVP]-F-F2A-PAC |
| PDL1 | 100516-M03 | 1761 | 3996 | CD8SP-V5-[hTCRb-KACIAH]-F-P2A-CD8SP-PDL1-Atezoli-vL-Gly-Ser-Linker-PDL1-Atezoli-vH-Myc-[hTCRa-CSDVP]-F-F2A-PAC |
| PDL1 | 100516-N03 | 1762 | 3997 | CD8SP-V5-[hTCRb-KACIAH]-F-P2A-CD8SP-PDL1-SP142-vL-Gly-Ser-Linker-PDL1-SP142-vH-Myc-[hTCRa-CSDVP]-F-F2A-PAC |
| PDL1 | 100516-L03 | 1763 | 3998 | CD8SP-V5-[hTCRb-KACIAH]-F-P2A-CD8SP-PDL1-10A5-vL-Gly-Ser-Linker-PDL1-10A5-vH-Myc-[hTCRa-CSDVP]-F-F2A-PAC |
| PSCA | 021616-M05 | 1764 | 3999 | CD8SP-V5-[hTCRb-KACIAH]-F-P2A-CD8SP-PSCA-Ha14-121-vL-Gly-Ser-Linker-PSCA-Ha14-121-vH-Myc-[hTCRa-CSDVP]-F-F2A-PAC |
| PSCA | 021616-S03 | 1765 | 4000 | CD8SP-V5-[hTCRb-KACIAH]-F-P2A-CD8SP-PSCA-Ha14-117-vL-Gly-Ser-Linker-PSCA-Ha14-117-vH-Myc-[hTCRa-CSDVP]-F-F2A-PAC |
| PR1/MHC | 091216-B03 | 1766 | 4001 | CD8SP-V5-[hTCRb-KACIAH]-F-P2A-CD8SP-PR1-vL-Gly-Ser-Linker-PR1-vH-Myc-[hTCRa-CSDVP]-F-F2A-PAC |
| PSMA | 091216-E03 | 1767 | 4002 | CD8SP-V5-[hTCRb-KACIAH]-F-P2A-CD8SP-PSMA-006-vL-Gly-Ser-Linker-PSMA-006-vH-Myc-[hTCRa-CSDVP]-F-F2A-PAC |
| PSMA | | 1768 | 4003 | CD8SP-V5-[hTCRb-KACIAH]-F-P2A-CD8SP-PSMA-J591-vL-Gly-Ser-Linker-PSMA-J591-vH-Myc-[hTCRa-CSDVP]-F-F2A-PAC |
| PTK7 | | 1769 | 4004 | CD8SP-V5-[hTCRb-KACIAH]-F-P2A-CD8SP-PTK7-hSC6-23-vL-Gly-Ser-Linker-PTK7-hSC6-23-vH-Myc-[hTCRa-CSDVP]-F-F2A-PAC |
| PTK7 | | 1770 | 4005 | CD8SP-V5-[hTCRb-KACIAH]-F-P2A-CD8SP-PTK7-SC6-10-2-vL-Gly-Ser-Linker-PTK7-SC6-10-2-vH-Myc-[hTCRa-CSDVP]-F-F2A-PAC |
| ROR1 | 092216-E08 | 1771 | 4006 | CD8SP-V5-[hTCRb-KACIAH]-F-P2A-CD8SP-ROR1-4A5-vL-Gly-Ser-Linker-ROR1-4A5-vH-Myc-[hTCRa-CSDVP]-F-F2A-PAC |
| ROR1 | 092216-F05 | 1772 | 4007 | CD8SP-V5-[hTCRb-KACIAH]-F-P2A-CD8SP-ROR1-4C10-vL-Gly-Ser-Linker-ROR1-4C10-vH-Myc-[hTCRa-CSDVP]-F-F2A-PAC |
| Mesothelin | | 1773 | 4008 | CD8SP-V5-[hTCRb-KACIAH]-F-P2A-CD8SP-SD1-vHH-Gly-Ser-Linker-SD2-vHH-Myc-[hTCRa-CSDVP]-F-F2A-PAC |
| SLea | | 1774 | 4009 | CD8SP-V5-[hTCRb-KACIAH]-F-P2A-CD8SP-SLea-7E3-vL-Gly-Ser-Linker-SLea-7E3-vH-Myc-[hTCRa-CSDVP]-F-F2A-PAC |
| SLea | | 1775 | 4010 | CD8SP-V5-[hTCRb-KACIAH]-F-P2A-CD8SP-SLea-5B1-vL-Gly-Ser-Linker-SLea-5B1-vH-Myc-[hTCRa-CSDVP]-F-F2A-PAC |
| SSEA4 | 091516-I06 | 1776 | 4011 | CD8SP-V5-[hTCRb-KACIAH]-F-P2A-CD8SP-SSEA4-vL-Gly-Ser-Linker-SSEA4-vH-Myc-[hTCRa-CSDVP]-F-F2A-PAC |
| Tyrosinase/MHC | | 1777 | 4012 | CD8SP-V5-[hTCRb-KACIAH]-F-P2A-CD8SP-TA2-vL-Gly-Ser-Linker-TA2-vH-Myc-[hTCRa-CSDVP]-F-F2A-PAC |
| TCRB1 | 030816-D04 | 1778 | 4013 | CD8SP-V5-[hTCRb-KACIAH]-F-P2A-CD8SP-TCRB1-CP01-E09-vL-Gly-Ser-Linker-TCRB1-CP01-E09-vH-Myc-[hTCRa-CSDVP]-F-F2A-PAC |
| TCRB1 | 030816-B07 | 1779 | 4014 | CD8SP-V5-[hTCRb-KACIAH]-F-P2A-CD8SP-TCRB1-Jovil-vL-Gly-Ser-Linker-TCRB1-Jovil-vH-Myc-[hTCRa-CSDVP]-F-F2A-PAC |

TABLE 7E-continued

SIRs Targeting Different Antigens on SIR10-Type Backbone

| TARGET | CLONE ID | SEQ ID-DNA | SEQ ID-PRT | NAME |
|---|---|---|---|---|
| TCRB2 | | 1780 | 4015 | CD8SP-V5-[hTCRb-KACIAH]-F-P2A-CD8SP-TCRB2-CP01-D05-vL-Gly-Ser-Linker-TCRB2-CP01-D05-vH-Myc-[hTCRa-CSDVP]-F-F2A-PAC |
| TCRB2 | 030816-C05 | 1781 | 4016 | CD8SP-V5-[hTCRb-KACIAH]-F-P2A-CD8SP-TCRB2-CP01-E05-vL-Gly-Ser-Linker-TCRB2-CP01-E05-vH-Myc-[hTCRa-CSDVP]-F-F2A-PAC |
| TCRgd | | 1782 | 4017 | CD8SP-V5-[hTCRb-KACIAH]-F-P2A-CD8SP-TCRgd-G5-4-vL-Gly-Ser-Linker-TCRgd-G5-4-vH-Myc-[hTCRa-CSDVP]-F-F2A-PAC |
| hTERT/MHC | 021616-K01 | 1783 | 4018 | CD8SP-V5-[hTCRb-KACIAH]-F-P2A-CD8SP-TERT-4A9-T540-vL-Gly-Ser-Linker-TERT-4A9-T540-vH-Myc-[hTCRa-CSDVP]-F-F2A-PAC |
| hTERT/MHC | 021216-L07 | 1784 | 4019 | CD8SP-V5-[hTCRb-KACIAH]-F-P2A-CD8SP-TERT-3G3-T865-vL-Gly-Ser-Linker-TERT-3G3-T865-vH-Myc-[hTCRa-CSDVP]-F-F2A-PAC |
| TGFBR2 | | 1785 | 4020 | CD8SP-V5-[hTCRb-KACIAH]-F-P2A-CD8SP-TGFBR2-Ab1-vL-Gly-Ser-Linker-TGFBR2-Ab1-vH-Myc-[hTCRa-CSDVP]-F-F2A-PAC |
| TIM1 | | 1786 | 4021 | CD8SP-V5-[hTCRb-KACIAH]-F-P2A-CD8SP-TIM1-HVCR1-270-2-vL-Gly-Ser-Linker-TIM1-HVCR1-270-2-vH-Myc-[hTCRa-CSDVP]-F-F2A-PAC |
| TIM1 | | 1787 | 4022 | CD8SP-V5-[hTCRb-KACIAH]-F-P2A-CD8SP-TIM1-HVCR1-ARD5-vL-Gly-Ser-Linker-TIM1-HVCR1-ARD5vH-Myc-[hTCRa-CSDVP]-F-F2A-PAC |
| TnAg | 050216-A04 | 1788 | 4023 | CD8SP-V5-[hTCRb-KACIAH]-F-P2A-CD8SP-TnAg-vL-Gly-Ser-Linker-TnAg-vH-Myc-[hTCRa-CSDVP]-F-F2A-PAC |
| Tn-Muc1 | 092816-C01 | 1789 | 4024 | CD8SP-V5-[hTCRb-KACIAH]-F-P2A-CD8SP-TnMuc1-hu5E5-RHA8-RKA-2-vL-Gly-Ser-Linker-TnMuc1-hu5E5-RHA8-RKA-2vH-Myc-[hTCRa-CSDVP]-F-F2A-PAC |
| MPL | 092816-F01 | 1790 | 4025 | CD8SP-V5-[hTCRb-KACIAH]-F-P2A-CD8SP-hTPO-Myc-[hTCRa-CSDVP]-F-F2A-PAC |
| TROP2 | | 1791 | 4026 | CD8SP-V5-[hTCRb-KACIAH]-F-P2A-CD8SP-TROP2-ARA47-HV3KV3-vL-Gly-Ser-Linker-TROP2-ARA47-HV3KV3-vH-Myc-[hTCRa-CSDVP]-F-F2A-PAC |
| TROP2 | | 1792 | 4027 | CD8SP-V5-[hTCRb-KACIAH]-F-P2A-CD8SP-TROP2-h7E6-SVG-vL-Gly-Ser-Linker-TROP2-h7E6-SVG-vH-Myc-[hTCRa-CSDVP]-F-F2A-PAC |
| TSHR | 091516-O06 | 1793 | 4028 | CD8SP-V5-[hTCRb-KACIAH]-F-P2A-SP-TSHb-Gly-Ser-Linker-CGHa-Myc-[hTCRa-CSDVP]-F-F2A-PAC |
| TSHR | | 1794 | 4029 | CD8SP-V5-[hTCRb-KACIAH]-F-P2A-CD8SP-TSHR-K1-70-vL-Gly-Ser-Linker-TSHR-K1-70-vH-Myc-[hTCRa-CSDVP]-F-F2A-PAC |
| TSHR | 042916-E03 | 1795 | 4030 | CD8SP-V5-[hTCRb-KACIAH]-F-P2A-CD8SP-TSHR-KB1-vL-Gly-Ser-Linker-TSHR-KB1-vH-Myc-[hTCRa-CSDVP]-F-F2A-PAC |
| TSHR | | 1796 | 4031 | CD8SP-V5-[hTCRb-KACIAH]-F-P2A-CD8SP-TSHR-5C9-vL-Gly-Ser-Linker-TSHR-5C9-vH-Myc-[hTCRa-CSDVP]-F-F2A-PAC |
| TSLPR | 091216-C03 | 1797 | 4032 | CD8SP-V5-[hTCRb-KACIAH]-F-P2A-CD8SP-TSLPR-vL-Gly-Ser-Linker-TSLPR-vH-Myc-[hTCRa-CSDVP]-F-F2A-PAC |
| Tyrosinase/MHC | 021716-F03 | 1798 | 4033 | CD8SP-V5-[hTCRb-KACIAH]-F-P2A-CD8SP-Tyros-B2-vL-Gly-Ser-Linker-Tyros-B2-vH-Myc-[hTCRa-CSDVP]-F-F2A-PAC |
| Tyrosinase/MHC | 021616-R07 | 1799 | 4034 | CD8SP-V5-[hTCRb-KACIAH]-F-P2A-CD8SP-Tyros-MC1-vL-Gly-Ser-Linker-Tyros-MC1-vH-Myc-[hTCRa-CSDVP]-F-F2A-PAC |
| Tyrosinase/MHC | | 1800 | 4035 | CD8SP-V5-[hTCRb-KACIAH]-F-P2A-CD8SP-Tyrosinase-B2-vL-Gly-Ser-Linker-Tyrosinase-B2-vH-Myc-[hTCRa-CSDVP]-F-F2A-PAC |

TABLE 7E-continued

SIRs Targeting Different Antigens on SIR10-Type Backbone

| TARGET | CLONE ID | SEQ ID-DNA | SEQ ID-PRT | NAME |
|---|---|---|---|---|
| VEGFR3 | | 1801 | 4036 | CD8SP-V5-[hTCRb-KACIAH]-F-P2A-CD8SP-VEGFR3-Ab1-vL-Gly-Ser-Linker-VEGFR3-Ab1-vH-Myc-[hTCRa-CSDVP]-F-F2A-PAC |
| WT1/MHC | | 1802 | 4037 | CD8SP-V5-[hTCRb-KACIAH]-F-P2A-CD8SP-WT1-Ab1-vL-Gly-Ser-Linker-WT1-Ab1-vH-Myc-[hTCRa-CSDVP]-F-F2A-PAC |
| WT1/MHC | 091216-D03 | 1803 | 4038 | CD8SP-V5-[hTCRb-KACIAH]-F-P2A-CD8SP-WT1-Ab5-vL-Gly-Ser-Linker-WT1-Ab5-vH-Myc-[hTCRa-CSDVP]-F-F2A-PAC |
| WT1/MHC | 091216-I03 | 1804 | 4039 | CD8SP-V5-[hTCRb-KACIAH]-F-P2A-CD8SP-MYC3-WT1-Ab13-vL-Gly-Ser-Linker-WT1-Ab13-vH-Myc-[hTCRa-CSDVP]-F-F2A-PAC |
| WT1/MHC | 091216-J03 | 1805 | 4040 | CD8SP-V5-[hTCRb-KACIAH]-F-P2A-CD8SP-MYC3-WT1-Ab15-vL-Gly-Ser-Linker-WT1-Ab15-vH-Myc-[hTCRa-CSDVP]-F-F2A-PAC |
| CD123 | | 1806 | 4041 | CD8SP-V5-[hTCRb-KACIAH]-F-P2A-CD8SP-CD123-1172-vL-Gly-Ser-Linker-CD123-1172-vH-Myc-[hTCRa-CSDVP]-F-F2A-PAC |
| CDH19 | | 1807 | 4042 | CD8SP-V5-[hTCRb-KACIAH]-F-P2A-CD8SP-CDH19-4B10-vL-Gly-Ser-Linker-CDH19-4B10-vH-Myc-[hTCRa-CSDVP]-F-F2A-PAC |
| Folate Receptor beta | | 1808 | 4043 | CD8SP-V5-[hTCRb-KACIAH]-F-P2A-CD8SP-FRbeta-m923-vL-Gly-Ser-Linker-FRbeta-m923-vH-Myc-[hTCRa-CSDVP]-F-F2A-PAC |
| LHR | | 1809 | 4044 | CD8SP-V5-[hTCRb-KACIAH]-F-P2A-CD8SP-LHR-8B7-vL-Gly-Ser-Linker-LHR-8B7-vH-Myc-[hTCRa-CSDVP]-F-F2A-PAC |
| LHR | | 1810 | 4045 | CD8SP-V5-[hTCRb-KACIAH]-F-P2A-CD8SP-LHR-5F4-21-vL-Gly-Ser-Linker-LHR-5F4-21-vH-Myc-[hTCRa-CSDVP]-F-F2A-PAC |
| B7H4 | | 1811 | 4046 | CD8SP-V5-[hTCRb-KACIAH]-F-P2A-CD8SP-B7H4-hu22C10-vL-Gly-Ser-Linker-B7H4-hu22C10-vH-Myc-[hTCRa-CSDVP]-F-F2A-PAC |
| B7H4 | | 1812 | 4047 | CD8SP-V5-[hTCRb-KACIAH]-F-P2A-CD8SP-B7H4-hu1D11-vL-Gly-Ser-Linker-B7H4-hu1D11-vH-Myc-[hTCRa-CSDVP]-F-F2A-PAC |
| IgE | | 1813 | 4048 | CD8SP-V5-[hTCRb-KACIAH]-F-P2A-CD8SP-IgE-omalizumab-vL-Gly-Ser-Linker-IgE-omalizumab-vH-Myc-[hTCRa-CSDVP]-F-F2A-PAC |
| CD23 | 121416-E04 | 1814 | 4049 | CD8SP-V5-[hTCRb-KACIAH]-F-P2A-CD8SP-CD23-p5E8-vL-Gly-Ser-Linker-CD23-p5E8-vH-Myc-[hTCRa-CSDVP]-F-F2A-PAC |
| GCC | 121516-F01 | 1815 | 4050 | CD8SP-V5-[hTCRb-KACIAH]-F-P2A-CD8SP-GCC-5F9-vL-Gly-Ser-Linker-GCC-5F9-vH-Myc-[hTCRa-CSDVP]-F-F2A-PAC |
| GCC | 121416-F01 | 1816 | 4051 | CD8SP-V5-[hTCRb-KACIAH]-F-P2A-CD8SP-GCC-Ab229-vL-Gly-Ser-Linker-GCC-Ab229-vH-Myc-[hTCRa-CSDVP]-F-F2A-PAC |
| CD200R | | 11454 | 13411 | CD8SP-V5-[hTCRb-KACIAH]-F-P2A-CD8SP-CD2 0 0R-huDx182-vL-Gly-Ser-Linker-CD200R-huDx182-vH-Myc-[hTCRa-CSDVP]-F-F2A-PAC |
| AFP/MHC I | 012617-M05 | 11455 | 13412 | CD8SP-V5-[hTCRb-KACIAH]-F-P2A-CD8SP-AFP-61-vL-Gly-Ser-Linker-AFP-61-vH-Myc-[hTCRa-CSDVP]-F-F2A-PAC |
| AFP/MHC I | 012617-N02 | 11456 | 13413 | CD8SP-V5-[hTCRb-KACIAH]-F-P2A-CD8SP-AFP-76-vL-Gly-Ser-Linker-AFP-76-vH-Myc-[hTCRa-CSDVP]-F-F2A-PAC |
| AFP/MHC I | 021317-E02 | 11457 | 13414 | CD8SP-V5-[hTCRb-KACIAH]-F-P2A-CD8SP-AFP-79-vL-Gly-Ser-Linker-AFP-79-vH-Myc-[hTCRa-CSDVP]-F-F2A-PAC |
| BCMA | 031517-U01 | 11458 | 13415 | CD8SP-V5-[hTCRb-KACIAH]-F-P2A-CD8SP-BCMA-ET-03-vL-Gly-Ser-Linker-BCMA-ET-03-vH-Myc-[hTCRa-CSDVP]-F-F2A-PAC |
| BCMA | 031517-S02 | 11459 | 13416 | CD8SP-V5-[hTCRb-KACIAH]-F-P2A-CD8SP-BCMA-huC11.D5.3L1H3-vL-Gly-Ser-Linker-BCMA-huC11.D5.3L1H3-vH-Myc-[hTCRa-CSDVP]-F-F2A-PAC |
| BCMA | 031517-T06 | 11460 | 13417 | CD8SP-V5-[hTCRb-KACIAH]-F-P2A-CD8SP-BCMA-huC13-F12-vL-Gly-Ser-Linker-BCMA-huC13-F12-vH-Myc-[hTCRa-CSDVP]-F-F2A-PAC |

TABLE 7E-continued

SIRs Targeting Different Antigens on SIR10-Type Backbone

| TARGET | CLONE ID | SEQ ID-DNA | SEQ ID-PRT | NAME |
|---|---|---|---|---|
| CD123 | 012517-C12 | 11461 | 13418 | CD8SP-V5-[hTCRb-KACIAH]-F-P2A-CD8SP-CD123-DART-1-vL-Gly-Ser-Linker-CD123-DART-1-vH-Myc-[hTCRa-CSDVP]-F-F2A-PAC |
| CD123 | 012517-G12 | 11462 | 13419 | CD8SP-V5-[hTCRb-KACIAH]-F-P2A-CD8SP-CD123-DART-2-vL-Gly-Ser-Linker-CD123-DART-2-vH-Myc-[hTCRa-CSDVP]-F-F2A-PAC |
| CD123 |  | 11463 | 13420 | CD8SP-V5-[hTCRb-KACIAH]-F-P2A-CD8SP-CD123-13RB18-vL-Gly-Ser-Linker-CD123-13RB18-vH-Myc-[hTCRa-CSDVP]-F-F2A-PAC |
| CD123 |  | 11464 | 13421 | CD8SP-V5-[hTCRb-KACIAH]-F-P2A-CD8SP-CD123-hu3E3-vL-Gly-Ser-Linker-CD123-hu3E3-vH-Myc-[hTCRa-CSDVP]-F-F2A-PAC |
| CD123 | 012517-F12 | 11465 | 13422 | CD8SP-V5-[hTCRb-KACIAH]-F-P2A-CD8SP-CD123-9F6-vL-Gly-Ser-Linker-CD123-9F6-vH-Myc-[hTCRa-CSDVP]-F-F2A-PAC |
| CD123 |  | 11466 | 13423 | CD8SP-V5-[hTCRb-KACIAH]-F-P2A-CD8SP-CD123-I3RB2-vL-Gly-Ser-Linker-CD123-I3RB2-vH-Myc-[hTCRa-CSDVP]-F-F2A-PAC |
| CD123 | 012517-H12 | 11467 | 13424 | CD8SP-V5-[hTCRb-KACIAH]-F-P2A-CD8SP-CD123-1176-vL-Gly-Ser-Linker-CD123-1176-vH-Myc-[hTCRa-CSDVP]-F-F2A-PAC |
| CD123 | 012517-J12 | 11468 | 13425 | CD8SP-V5-[hTCRb-KACIAH]-F-P2A-CD8SP-CD123-8B11-vL-Gly-Ser-Linker-CD123-8B11-vH-Myc-[hTCRa-CSDVP]-F-F2A-PAC |
| CD123 | 012517-K12 | 11469 | 13426 | CD8SP-V5-[hTCRb-KACIAH]-F-P2A-CD8SP-CD123-2B8-vL-Gly-Ser-Linker-CD123-2B8-vH-Myc-[hTCRa-CSDVP]-F-F2A-PAC |
| CD123 | 012517-L12 | 11470 | 13427 | CD8SP-V5-[hTCRb-KACIAH]-F-P2A-CD8SP-CD123-9D7-vL-Gly-Ser-Linker-CD123-9D7-vH-Myc-[hTCRa-CSDVP]-F-F2A-PAC |
| CD123 | 012517-M12 | 11471 | 13428 | CD8SP-V5-[hTCRb-KACIAH]-F-P2A-CD8SP-CD123-3B10-vL-Gly-Ser-Linker-CD123-3B10-vH-Myc-[hTCRa-CSDVP]-F-F2A-PAC |
| CD19 | 010417-H05 | 11472 | 13429 | CD8SP-V5-[hTCRb-KACIAH]-F-P2A-CD8SP-CD19-MEDI-3649-vL-Gly-Ser-Linker-CD19-MEDI-3649-vH-Myc-[hTCRa-CSDVP]-F-F2A-PAC |
| CD19 | 031517-P03 | 11473 | 13430 | CD8SP-V5-[hTCRb-KACIAH]-F-P2A-CD8SP-CD19-Medrex-2 4DI-vL-Gly-Ser-Linker-CD19-Medrex-24D1-vH-Myc-[hTCRa-CSDVP]-F-F2A-PAC |
| CD19 | 012417-H04 | 11474 | 13431 | CD8SP-V5-[hTCRb-KACIAH]-F-P2A-CD8SP-CD19-MORO028-vL-Gly-Ser-Linker-CD19-MOR0028-vH-Myc-[hTCRa-CSDVP]-F-F2A-PAC |
| CD19 | 012417-I04 | 11475 | 13432 | CD8SP-V5-[hTCRb-KACIAH]-F-P2A-CD8SP-CD19-HD37-H2L1-vL-Gly-Ser-Linker-CD19-HD37-H2L1-vH-Myc-[hTCRa-CSDVP]-F-F2A-PAC |
| CD19 | 020817-U02 | 11476 | 13433 | CD8SP-V5-[hTCRb-KACIAH]-F-P2A-CD8SP-CD19-huBly3-vL-Gly-Ser-Linker-CD19-huBly3-vH-Myc-[hTCRa-CSDVP]-F-F2A-PAC |
| CD19 | 012617-O05 | 11477 | 13434 | CD8SP-V5-[hTCRb-KACIAH]-F-P2A-CD8SP-CD19-huSJ25C1-vL-Gly-Ser-Linker-CD19-huSJ25C1-vH-Myc-[hTCRa-CSDVP]-F-F2A-PAC |
| CD19 | 022817-J01, 031517-X04 | 11478 | 13435 | CD8SP-V5-[hTCRb-KACIAH]-F-P2A-CD8SP-CD19-hB4-vL-Gly-Ser-Linker-CD19-hB4-vH-Myc-[hTCRa-CSDVP]-F-F2A-PAC |
| CD19 | 070517-H02 | 11479 | 13436 | CD8SP-V5-[hTCRb-KACIAH]-F-P2A-CD8SP-CD19-hu-mROO5-vL-Gly-Ser-Linker-CD19-hu-mROO5-vH-Myc-[hTCRa-CSDVP]-F-F2A-PAC |
| CD19 |  | 11480 | 13437 | CD8SP-V5-[hTCRb-KACIAH]-F-P2A-CD8SP-CD19-hA19-vL-Gly-Ser-Linker-CD19-hA19-vH-Myc-[hTCRa-CSDVP]-F-F2A-PAC |
| CD20 |  | 11481 | 13438 | CD8SP-V5-[hTCRb-KACIAH]-F-P2A-CD8SP-CD20-Leu16-vL-Gly-Ser-Linker-CD20-Leu16-vH-Myc-[hTCRa-CSDVP]-F-F2A-PAC |
| CD20 |  | 11482 | 13439 | CD8SP-V5-[hTCRb-KACIAH]-F-P2A-CD8SP-CD20-11B8-vL-Gly-Ser-Linker-CD20-HB8-vH-Myc-[hTCRa-CSDVP]-F-F2A-PAC |

TABLE 7E-continued

SIRs Targeting Different Antigens on SIR10-Type Backbone

| TARGET | CLONE ID | SEQ ID-DNA | SEQ ID-PRT | NAME |
|---|---|---|---|---|
| CD20 | | 11483 | 13440 | CD8SP-V5-[hTCRb-KACIAH]-F-P2A-CD8SP-CD20-2C6-vL-Gly-Ser-Linker-CD20-2C6-vH-Myc-[hTCRa-CSDVP]-F-F2A-PAC |
| CD20 | 012617-S04 | 11484 | 13441 | CD8SP-V5-[hTCRb-KACIAH]-F-P2A-CD8SP-CD20-2H7-vL-Gly-Ser-Linker-CD20-2H7-vH-Myc-[hTCRa-CSDVP]-F-F2A-PAC |
| CD20 | | 11485 | 13442 | CD8SP-V5-[hTCRb-KACIAH]-F-P2A-CD8SP-CD20-hA20-vL-Gly-Ser-Linker-CD20-hA20-vH-Myc-[hTCRa-CSDVP]-F-F2A-PAC |
| CD20 | 012417-J04 | 11486 | 13443 | CD8SP-V5-[hTCRb-KACIAH]-F-P2A-CD8SP-CD20-BM-CA-1925-v4-vL-Gly-Ser-Linker-CD20-BM-CA-1925-v4-vH-Myc-[hTCRa-CSDVP]-F-F2A-PAC |
| CD20 | | 11487 | 13444 | CD8SP-V5-[hTCRb-KACIAH]-F-P2A-CD8SP-CD2 0-Ubli-v4-vL-Gly-Ser-Linker-CD2 0-Ubli-v4-vH-Myc-[hTCRa-CSDVP]-F-F2A-PAC |
| CD20 | 031517-W03 | 11488 | 13445 | CD8SP-V5-[hTCRb-KACIAH]-F-P2A-CD8SP-CD20-h1F5-vL-Gly-Ser-Linker-CD20-h1F5-vH-Myc-[hTCRa-CSDVP]-F-F2A-PAC |
| CD20 | | 11489 | 13446 | CD8SP-V5-[hTCRb-KACIAH]-F-P2A-CD8SP-CD20-7D8-vL-Gly-Ser-Linker-CD20-7D8-vH-Myc-[hTCRa-CSDVP]-F-F2A-PAC |
| CD20 | 012517-Q12 | 11490 | 13447 | CD8SP-V5-[hTCRb-KACIAH]-F-P2A-CD8SP-CD20-AME-33-vL-Gly-Ser-Linker-CD20-AME-33-vH-Myc-[hTCRa-CSDVP]-F-F2A-PAC |
| CD33 | 012517-I12 | 11491 | 13448 | CD8SP-V5-[hTCRb-KACIAH]-F-P2A-CD8SP-CD33-Boehr2800308-vL-Gly-Ser-Linker-CD33-Boehr2800308-vH-Myc-[hTCRa-CSDVP]-F-F2A-PAC |
| CD33 | 012317-A01 | 11492 | 13449 | CD8SP-V5-[hTCRb-KACIAH]-F-P2A-CD8SP-CD33-Him3-4-vL-Gly-Ser-Linker-CD33-Him3-4-vH-Myc-[hTCRa-CSDVP]-F-F2A-PAC |
| CD33 | 022217-X03 | 11493 | 13450 | CD8SP-V5-[hTCRb-KACIAH]-F-P2A-CD8SP-CD33-SGNh2H12-vL-Gly-Ser-Linker-CD33-SGNh2H12-vH-Myc-[hTCRa-CSDVP]-F-F2A-PAC |
| CD33 | 012317-C02 | 11494 | 13451 | CD8SP-V5-[hTCRb-KACIAH]-F-P2A-CD8SP-CD33-15G15-33-vL-Gly-Ser-Linker-CD33-15G15-33-vH-Myc-[hTCRa-CSDVP]-F-F2A-PAC |
| CD33 | 030317-T04 | 11495 | 13452 | CD8SP-V5-[hTCRb-KACIAH]-F-P2A-CD8SP-CD33-33H4-vL-Gly-Ser-Linker-CD33-33H4-vH-Myc-[hTCRa-CSDVP]-F-F2A-PAC |
| CD33 | | 11496 | 13453 | CD8SP-V5-[hTCRb-KACIAH]-F-P2A-CD8SP-CD33-33H4-2-vL-Gly-Ser-Linker-CD33-33H4-2-vH-Myc-[hTCRa-CSDVP]-F-F2A-PAC |
| CD33 | | 11497 | 13454 | CD8SP-V5-[hTCRb-KACIAH]-F-P2A-CD8SP-CD33-9C3-2-vL-Gly-Ser-Linker-CD33-9C3-2-vH-Myc-[hTCRa-CSDVP]-F-F2A-PAC |
| CD99 | 031517-R05 | 11498 | 13455 | CD8SP-V5-[hTCRb-KACIAH]-F-P2A-CD8SP-CD99-hu12E7-vL-Gly-Ser-Linker-CD99-hu12E7-vH-Myc-[hTCRa-CSDVP]-F-F2A-PAC |
| CLL1 | 012317-F02 | 11499 | 13456 | CD8SP-V5-[hTCRb-KACIAH]-F-P2A-CD8SP-CLL1-21C9-L2H3-vL-Gly-Ser-Linker-CLL1-21C9-L2H3-vH-Myc-[hTCRa-CSDVP]-F-F2A-PAC |
| CLL1 | 012317-G05 | 11500 | 13457 | CD8SP-V5-[hTCRb-KACIAH]-F-P2A-CD8SP-CLL1-6E7L4H1e-vL-Gly-Ser-Linker-CLL1-6E7L4H1e-vH-Myc-[hTCRa-CSDVP]-F-F2A-PAC |
| CLL1 | 012317-H02 | 11501 | 13458 | CD8SP-V5-[hTCRb-KACIAH]-F-P2A-CD8SP-CLL1-hu1075-v1-vL-Gly-Ser-Linker-CLL1-hu1075-v1-vH-Myc-[hTCRa-CSDVP]-F-F2A-PAC |
| CLL1 | 012316-I03 | 11502 | 13459 | CD8SP-V5-[hTCRb-KACIAH]-F-P2A-CD8SP-CLL1-hu1075-v2-vL-Gly-Ser-Linker-CLL1-hu1075-v2-vH-Myc-[hTCRa-CSDVP]-F-F2A-PAC |
| CS1 | 012517-A12 | 11503 | 13460 | CD8SP-V5-[hTCRb-KACIAH]-F-P2A-CD8SP-CS1-PDL241-vL-Gly-Ser-Linker-CS1-PDL241-vH-Myc-[hTCRa-CSDVP]-F-F2A-PAC |

TABLE 7E-continued

SIRs Targeting Different Antigens on SIR10-Type Backbone

| TARGET | CLONE ID | SEQ ID-DNA | SEQ ID-PRT | NAME |
|---|---|---|---|---|
| CS1 | 012517-B12 | 11504 | 13461 | CD8SP-V5-[hTCRb-KACIAH]-F-P2A-CD8SP-CS1-Hu27A-vL-Gly-Ser-Linker-CS1-Hu27A-vH-Myc-[hTCRa-CSDVP]-F-F2A-PAC |
| CS1 | 012517-D12 | 11505 | 13462 | CD8SP-V5-[hTCRb-KACIAH]-F-P2A-CD8SP-CS1-ScHu34C3-vL-Gly-Ser-Linker-CS1-ScHu34C3-vH-Myc-[hTCRa-CSDVP]-F-F2A-PAC |
| CS1 | 012517-N12 | 11506 | 13463 | CD8SP-V5-[hTCRb-KACIAH]-F-P2A-CD8SP-CS1-Hu31-D2-vL-Gly-Ser-Linker-CS1-Hu31-D2-vH-Myc-[hTCRa-CSDVP]-F-F2A-PAC |
| CS1 | 012517-O12 | 11507 | 13464 | CD8SP-V5-[hTCRb-KACIAH]-F-P2A-CD8SP-CS1-Luc34-vL-Gly-Ser-Linker-CS1-Luc34-vH-Myc-[hTCRa-CSDVP]-F-F2A-PAC |
| CS1 | 012517-P12 | 11508 | 13465 | CD8SP-V5-[hTCRb-KACIAH]-F-P2A-CD8SP-CS1-LucX2-vL-Gly-Ser-Linker-CS1-LucX2-vH-Myc-[hTCRa-CSDVP]-F-F2A-PAC |
| FITC | 021517-K03 | 11509 | 13466 | CD8SP-V5-[hTCRb-KACIAH]-F-P2A-CD8SP-FITC-4M-53-vL-DDAKK-linker-FITC-4M-53-vH-Myc-[hTCRa-CSDVP]-F-F2A-PAC |
| FITC | 012317-L03 | 11510 | 13467 | CD8SP-V5-[hTCRb-KACIAH]-F-P2A-CD8SP-FITC-E2-vH-Gly-Ser-Linker-FITC-E2-vL-Myc-[hTCRa-CSDVP]-F-F2A-PAC |
| GPRC5D | 021517-I01 | 11511 | 13468 | CD8SP-V5-[hTCRb-KACIAH]-F-P2A-CD8SP-GPRC5D-ET150-1-vL-Gly-Ser-Linker-GPRC5D-ET150-1-vH-Myc-[hTCRa-CSDVP]-F-F2A-PAC |
| GPRC5D | 031517-Q04 | 11512 | 13469 | CD8SP-V5-[hTCRb-KACIAH]-F-P2A-CD8SP-GPRC5D-ET150-2-vL-Gly-Ser-Linker-GPRC5D-ET150-2-vH-Myc-[hTCRa-CSDVP]-F-F2A-PAC |
| HLA-A2 | 021517-H04 | 11513 | 13470 | CD8SP-V5-[hTCRb-KACIAH]-F-P2A-CD8SP-HLA-A2-3PB2-vL-Gly-Ser-Linker-HLA-A2-3PB2-vH-Myc-[hTCRa-CSDVP]-F-F2A-PAC |
| HPV16-E7/MHC I | 012617-Q05 | 11514 | 13471 | CD8SP-V5-[hTCRb-KACIAH]-F-P2A-CD8SP-HPV16-7-8-vL-Gly-Ser-Linker-HPV16-7-8-vH-Myc-[hTCRa-CSDVP]-F-F2A-PAC |
| HPV16-E7/MHC I | 012617-R05 | 11515 | 13472 | CD8SP-V5-[hTCRb-KACIAH]-F-P2A-CD8SP-HPV16-2-vL-Gly-Ser-Linker-HPV16-2-vH-Myc-[hTCRa-CSDVP]-F-F2A-PAC |
| Tissue Factor 1 (TF1) | 021317-F07 | 11516 | 13473 | CD8SP-V5-[hTCRb-KACIAH]-F-P2A-CD8SP-TF1-98-vL-Gly-Ser-Linker-TF1-98-vH-Myc-[hTCRa-CSDVP]-F-F2A-PAC |
| Tn-Muc1 | 041917-I03 | 11517 | 13474 | CD8SP-V5-[hTCRb-KACIAH]-F-P2A-CD8SP-Tn-Muc1-5E5-vH-Gly-Ser-Linker-Tn-Muc1-5E5-vL-Myc-[hTCRa-CSDVP]-F-F2A-PAC |
| CD22 | 041917-J02 | 11518 | 13475 | CD8SP-V5-[hTCRb-KACIAH]-F-P2A-CD8SP-CD22-5-vH-Gly-Ser-Linker-CD22-5-vL-Myc-[hTCRa-CSDVP]-F-F2A-PAC |
| CD22 | 062717-002 | 11519 | 13476 | CD8SP-V5-[hTCRb-KACIAH]-F-P2A-CD8SP-CD22-10-vH-Gly-Ser-Linker-CD22-10-vL-Myc-[hTCRa-CSDVP]-F-F2A-PAC |
| CD22 | 041917-L04 | 11520 | 13477 | CD8SP-V5-[hTCRb-KACIAH]-F-P2A-CD8SP-CD22-31-vH-Gly-Ser-Linker-CD22-31-vL-Myc-[hTCRa-CSDVP]-F-F2A-PAC |
| CD22 | 062717-P06 | 11521 | 13478 | CD8SP-V5-[hTCRb-KACIAH]-F-P2A-CD8SP-CD22-53-vH-Gly-Ser-Linker-CD22-53-vL-Myc-[hTCRa-CSDVP]-F-F2A-PAC |
| CD22 | 062717-Q04 | 11522 | 13479 | CD8SP-V5-[hTCRb-KACIAH]-F-P2A-CD8SP-CD22-65-vH-Gly-Ser-Linker-CD22-65-vL-Myc-[hTCRa-CSDVP]-F-F2A-PAC |
| Igk-Light Chain | 071417-W08 | 11523 | 13480 | CD8SP-V5-[hTCRb-KACIAH]-F-P2A-CD8SP-Kappa-LC1-vL-Gly-Ser-Linker-Kappa-LC1-vH-Myc-[hTCRa-CSDVP]-F-F2A-PAC |
| PTK7 | 071417-Z03 | 11524 | 13481 | CD8SP-V5-[hTCRb-KACIAH]-F-P2A-CD8SP-PTK7-7C8-vL-Gly-Ser-Linker-PTK7-7C8-vH-Myc-[hTCRa-CSDVP]-F-F2A-PAC |
| PTK7 | 071217-C03 | 11525 | 13482 | CD8SP-V5-[hTCRb-KACIAH]-F-P2A-CD8SP-PTK7-12C6a-vL-Gly-Ser-Linker-PTK7-12C6a-vH-Myc-[hTCRa-CSDVP]-F-F2A-PAC |

TABLE 7E-continued

SIRs Targeting Different Antigens on SIR10-Type Backbone

| TARGET | CLONE ID | SEQ ID-DNA | SEQ ID-PRT | NAME |
|---|---|---|---|---|
| CD19 | 081017-H01 | 11526 | 13483 | CD8SP-V5-[hTCRb-KACIAH]-F-P2A-CD8SP-hCD19-EUK5-13-vL-Gly-Ser-Linker-hCD19-EUK5-13-vH-Myc-[hTCRa-CSDVP]-F-F2A-PAC |
| Ras/MHC I | 092817-K09 | 11527 | 13484 | CD8SP-V5-[hTCRb-KACIAH]-F-P2A-CD8SP-Ras-Ab2-vL-Gly-Ser-Linker-Ras-Ab2-vH-Myc-[hTCRa-CSDVP]-F-F2A-PAC |
| Ras/MHC I | 092617-M09 | 11528 | 13485 | CD8SP-V5-[hTCRb-KACIAH]-F-P2A-CD8SP-Ras-Ab4-vL-Gly-Ser-Linker-Ras-Ab4-vH-Myc-[hTCRa-CSDVP]-F-F2A-PAC |
| CLD18A2 | 082317-G04 | 11529 | 13486 | CD8SP-V5-[hTCRb-KACIAH]-F-P2A-CD8SP-CLD18A2-43A11-vL-Gly-Ser-Linker-CLD18A2-43A11-vH-Myc-[hTCRa-CSDVP]-F-F2A-PAC |
| CLD18A2 | 082317-F08 | 11530 | 13487 | CD8SP-V5-[hTCRb-KACIAH]-F-P2A-CD8SP-CLD18A2-175D10-vL-Gly-Ser-Linker-CLD18A2-175D10-vH-Myc-[hTCRa-CSDVP]-F-F2A-PAC |
| CD43 | 090117-A04 | 11531 | 13488 | CD8SP-V5-[hTCRb-KACIAH]-F-P2A-CD8SP-CD43-huJL-1-257-10-vL-Gly-Ser-Linker-CD43-huJL-1-257-10-vH-Myc-[hTCRa-CSDVP]-F-F2A-PAC |
| CD69L | | 11532 | 13489 | CD8SP-V5-[hTCRb-KACIAH]-F-P2A-CD8SP-CD69L-DREG200-vL-Gly-Ser-Linker-CD69L-DREG200-vH-Myc-[hTCRa-CSDVP]-F-F2A-PAC |
| NY-ESO | 092817-L09, 072717-H02 | 11533 | 13490 | CD8SP-V5-[hTCRb-KACIAH]-F-P2A-CD8SP-NYESO-35-15-vL-Gly-Ser-Linker-NYESO-35-15-vH-Myc-[hTCRa-CSDVP]-F-F2A-PAC |
| P-glycoprotein | | 11534 | 13491 | CD8SP-V5-[hTCRb-KACIAH]-F-P2A-CD8SP-Pgp-9F11-vL-Gly-Ser-Linker-Pgp-9F11-vH-Myc-[hTCRa-CSDVP]-F-F2A-PAC |
| Streptag | | 11535 | 13492 | CD8SP-V5-[hTCRb-KACIAH]-F-P2A-CD8SP-Streptag-vL-Gly-Ser-Linker-Streptag-vH-Myc-[hTCRa-CSDVP]-F-F2A-PAC |
| MPL/TPO-R | | 11536 | 13493 | CD8SP-V5-[hTCRb-KACIAH]-F-P2A-CD8SP-MPL-hu-161-2-vL-Gly-Ser-Linker-MPL-hu-161-2-vH-Myc-[hTCRa-CSDVP]-F-F2A-PAC |
| P-glycoprotein | | 11537 | 13494 | CD8SP-V5-[hTCRb-KACIAH]-F-P2A-CD8SP-Pgp-MRK16-vL-Gly-Ser-Linker-Pgp-MRK16-vH-Myc-[hTCRa-CSDVP]-F-F2A-PAC |
| BCMA | | 11538 | 13495 | CD8SP-V5-[hTCRb-KACIAH]-F-P2A-CD8SP-BCMA-huC12A3-L3H3-vL2-Gly-Ser-Linker-BCMA-huC12A3-L3H3-vH2-Myc-[hTCRa-CSDVP]-F-F2A-PAC |
| BCMA | | 11539 | 13496 | CD8SP-V5-[hTCRb-KACIAH]-F-P2A-CD8SP-BCMA-huC13-F12-L1H2-vL2-Gly-Ser-Linker-BCMA-huC13-F12-L1H2-vH2-Myc-[hTCRa-CSDVP]-F-F2A-PAC |
| CD179a | 092517-I01 | 11540 | 13497 | CD8SP-V5-[hTCRb-KACIAH]-F-P2A-CD8SP-CD179a-2460-B04-vL-Gly-Ser-Linker-CD179a-2460-B04-vH-Myc-[hTCRa-CSDVP]-F-F2A-PAC |
| CD179a | 092517-J02 | 11541 | 13498 | CD8SP-V5-[hTCRb-KACIAH]-F-P2A-CD8SP-CD179a-2462-E07-vL-Gly-Ser-Linker-CD179a-2462-E07-vH-Myc-[hTCRa-CSDVP]-F-F2A-PAC |
| MPL/TPO-R | 092817-G09 | 11542 | 13499 | CD8SP-V5-[hTCRb-KACIAH]-F-P2A-CD8SP-MPL-hu-175-2-vL-Gly-Ser-Linker-MPL-hu-175-2-vH-Myc-[hTCRa-CSDVP]-F-F2A-PAC |
| MPL/TPO-R | 092517-H02 | 11543 | 13500 | CD8SP-V5-[hTCRb-KACIAH]-F-P2A-CD8SP-MPL-hu-111-2-vL-Gly-Ser-Linker-MPL-hu-111-2-vH-Myc-[hTCRa-CSDVP]-F-F2A-PAC |
| CD19 | 092517-F01 | 11544 | 13501 | CD8SP-V5-[hTCRb-KACIAH]-F-P2A-CD8SP-hu-FMC65-1-vL-Gly-Ser-Linker-hu-FMC65-1-vH-Myc-[hTCRa-CSDVP]-F-F2A-PAC |
| CD22 | 012517-E12 | 11545 | 13502 | CD8SP-V5-[hTCRb-KACIAH]-F-P2A-CD8SP-CD22-HA22-vL-Gly-Ser-Linker-CD22-HA22-vH-Myc-[hTCRa-CSDVP]-F-F2A-PAC |

TABLE 7E-continued

SIRs Targeting Different Antigens on SIR10-Type Backbone

| TARGET | CLONE ID | SEQ ID-DNA | SEQ ID-PRT | NAME |
|---|---|---|---|---|
| STEAP1 | 112017-M06 | 11546 | 13503 | CD8SP-V5-[hTCRb-KACIAH]-F-P2A-CD8SP-STEAP1-hu120-vL-Gly-Ser-Linker-STEAP1-hu120-vH-Myc-[hTCRa-CSDVP]-F-F2A-PAC |
| Liv1 | | 11547 | 13504 | CD8SP-V5-[hTCRb-KACIAH]-F-P2A-CD8SP-hLiv1-mAb2-vL-Gly-Ser-Linker-hLiv1-mAb2-vH-Myc-[hTCRa-CSDVP]-F-F2A-PAC |
| Nectin-4 | | 11548 | 13505 | CD8SP-V5-[hTCRb-KACIAH]-F-P2A-CD8SP-hu-Nectin4-mAb1-vL-Gly-Ser-Linker-hu-Nectin4-mAb1-vH-Myc-[hTCRa-CSDVP]-F-F2A-PAC |
| Cripto | 110617-C02 | 11549 | 13506 | CD8SP-V5-[hTCRb-KACIAH]-F-P2A-CD8SP-hu-Cripto-L1H2-vL-Gly-Ser-Linker-hu-Cripto-L1H2-vH-Myc-[hTCRa-CSDVP]-F-F2A-PAC |
| gpA33 | 110617-B02 | 11550 | 13507 | CD8SP-V5-[hTCRb-KACIAH]-F-P2A-CD8SP-hu-gpA33-vL-Gly-Ser-Linker-hu-gpA33-vH-Myc-[hTCRa-CSDVP]-F-F2A-PAC |
| ROR1 | 110817-I02 | 11551 | 13508 | CD8SP-V5-[hTCRb-KACIAH]-F-P2A-CD8SP-ROR1-DART4-vL-Gly-Ser-Linker-ROR1-DART4-vH-Myc-[hTCRa-CSDVP]-F-F2A-PAC |
| FLT3 | | 11552 | 13509 | CD8SP-V5-[hTCRb-KACIAH]-F-P2A-CD8SP-FLT3-8B5-vL-Gly-Ser-Linker-FLT3-8B5-vH-Myc-[hTCRa-CSDVP]-F-F2A-PAC |
| FLT3 | | 11553 | 13510 | CD8SP-V5-[hTCRb-KACIAH]-F-P2A-CD8SP-FLT3-10E3-vL-Gly-Ser-Linker-FLT3-10E3-vH-Myc-[hTCRa-CSDVP]-F-F2A-PAC |
| BCMA | | 11554 | 13511 | CD8SP-V5-[hTCRb-KACIAH]-F-P2A-CD8SP-BCMA-AJ-vL-Gly-Ser-Linker-BCMA-AJ-vH-Myc-[hTCRa-CSDVP]-F-F2A-PAC |
| BCMA | | 11555 | 13512 | CD8SP-V5-[hTCRb-KACIAH]-F-P2A-CD8SP-BCMA-FS-vL-Gly-Ser-Linker-BCMA-FS-vH-Myc-[hTCRa-CSDVP]-F-F2A-PAC |
| BCMA | | 11556 | 13513 | CD8SP-V5-[hTCRb-KACIAH]-F-P2A-CD8SP-BCMA-NM-vL-Gly-Ser-Linker-BCMA-NM-vH-Myc-[hTCRa-CSDVP]-F-F2A-PAC |
| BCMA | | 11557 | 13514 | CD8SP-V5-[hTCRb-KACIAH]-F-P2A-CD8SP-BCMA-PC-vL-Gly-Ser-Linker-BCMA-PC-vH-Myc-[hTCRa-CSDVP]-F-F2A-PAC |
| BCMA | | 11558 | 13515 | CD8SP-V5-[hTCRb-KACIAH]-F-P2A-CD8SP-BCMA-PP-vL-Gly-Ser-Linker-BCMA-PP-vH-Myc-[hTCRa-CSDVP]-F-F2A-PAC |
| BCMA | | 11559 | 13516 | CD8SP-V5-[hTCRb-KACIAH]-F-P2A-CD8SP-BCMA-RD-vL-Gly-Ser-Linker-BCMA-RD-vH-Myc-[hTCRa-CSDVP]-F-F2A-PAC |
| BCMA | | 11560 | 13517 | CD8SP-V5-[hTCRb-KACIAH]-F-P2A-CD8SP-BCMA-TS-vL-Gly-Ser-Linker-BCMA-TS-vH-Myc-[hTCRa-CSDVP]-F-F2A-PAC |
| BCMA | | 11561 | 13518 | CD8SP-V5-[hTCRb-KACIAH]-F-P2A-CD8SP-BCMA-BB-CAR02-vL-Gly-Ser-Linker-BCMA-BB-CAR02-vH-Myc-[hTCRa-CSDVP]-F-F2A-PAC |
| CLL1 | | 11562 | 13519 | CD8SP-V5-[hTCRb-KACIAH]-F-P2A-CD8SP-CLL1-24C1-vL-Gly-Ser-Linker-CLL1-24C1-vH-Myc-[hTCRa-CSDVP]-F-F2A-PAC |
| CLL1 | | 11563 | 13520 | CD8SP-V5-[hTCRb-KACIAH]-F-P2A-CD8SP-CLL1-24C8-vL-Gly-Ser-Linker-CLL1-24C8-vH-Myc-[hTCRa-CSDVP]-F-F2A-PAC |
| Mesothelin | | 11564 | 13521 | CD8SP-V5-[hTCRb-KACIAH]-F-P2A-CD8SP-MSLN-7D9-v3-vL-Gly-Ser-Linker-MSLN-7D9-v3-vH-Myc-[hTCRa-CSDVP]-F-F2A-PAC |
| Mesothelin | | 11565 | 13522 | CD8SP-V5-[hTCRb-KACIAH]-F-P2A-CD8SP-MSLN-hu22A10-vL-Gly-Ser-Linker-MSLN-hu22A10-vH-Myc-[hTCRa-CSDVP]-F-F2A-PAC |
| CD19 | | 11566 | 13523 | CD8SP-V5-[hTCRb-KACIAH]-F-P2A-CD8SP-hu-Bu13-vL-Gly-Ser-Linker-hu-Bu13-vH-Myc-[hTCRa-CSDVP]-F-F2A-PAC |
| BST1/CD157 | | 11567 | 13524 | CD8SP-V5-[hTCRb-KACIAH]-F-P2A-CD8SP-hu-BST1-A1-vL-Gly-Ser-Linker-hu-BST1-A1-vH-Myc-[hTCRa-CSDVP]-F-F2A-PAC |
| BST1/CD157 | | 11568 | 13525 | CD8SP-V5-[hTCRb-KACIAH]-F-P2A-CD8SP-hu-BST1-A2-vL-Gly-Ser-Linker-hu-BST1-A2-vH-Myc-[hTCRa-CSDVP]-F-F2A-PAC |

TABLE 7E-continued

SIRs Targeting Different Antigens on SIR10-Type Backbone

| TARGET | CLONE ID | SEQ ID-DNA | SEQ ID-PRT | NAME |
|---|---|---|---|---|
| BST1/CD157 | | 11569 | 13526 | CD8SP-V5-[hTCRb-KACIAH]-F-P2A-CD8SP-hu-BST1-A3-vL-Gly-Ser-Linker-hu-BST1-A3-vH-Myc-[hTCRa-CSDVP]-F-F2A-PAC |

TABLE 7F

Exemplary SIR Constructs Targeting CD19 with FMC63 Based Binding Domain(s)

| Clone ID | SEQ ID-DNA | SEQ ID-PRT | NAME |
|---|---|---|---|
| 050515-L05 | 900 | 3135 | CD8SP-FMC63-vL-V5-[TCRb-S57C-opt1]-F-P2A-SP-FMC63-vH-Myc-[TCRa-T48C-opt1]-F-F2A-PAC |
| 101415-M05 | 901 | 3136 | IgHSP-FMC63-vH-[hTCRb-C57C-opt]-F-P2A-CD8SP-FMC63-VL-MYC-[hTCRa-T48C-opt]-F-F2A-Pac |
| 100515-E03 | 902 | 3137 | CD8SP-FMC63-vL-Myc-[hTCRa-T48C-opt1]-F-F2A-FMC63-VH-V5-[hTCRb-C57C-opt1]-F-P2A-PAC |
| 021816-P07 | 903 | 3138 | CD8SP-FMC63-vL-[hTCRd-opt]-F-F2A-FMC63-vH-[hTCRg-opt]-F-P2A-PAC |
| 092515-Q03 | 904 | 3139 | CD8SP-FMC63-vL-MYC-[TCRa-T48C-opt1]-F-P2A-SP-FMC63-vH-MYC-[TCRd-opt]-F-F2A-Pac |
| 021116-E08 & 020416-C03 | 905 | 3140 | CD8SP-FMC63-vL-[huTCRa-opt2]-F-F2A-FMC63-vH-[hTCRa-opt2]-F-P2A-PAC |
| 012216-P08 | 906 | 3141 | CD8SP-FMC63-vL-[hTCRb-opt2]-F-P2A-SP-FMC63-vH-Myc-[hTCRb-opt2-deltaE]-F-P2A-PAC |
| 012216-Q05 | 907 | 3142 | CD8SP-FMC63-vL-V5-[hTCRg-opt]-F-P2A-SP-FMC63-vH-Myc-[hTCRg-opt]-F-P2A-PAC |
| 012216-R04 | 908 | 3143 | CD8SP-FMC63-vL-[hTCRd-opt]-F-F2A-FMC63-vH-Myc-[hTCRd-opt]-F-F2A-PAC |
| 012216-S02 | 909 | 3144 | CD8SP-FMC63-vL-[preTCRa-Del48]-F-F2A-FMC63-vH-Myc-[preTCRa-Del48]-F-F2A-PAC |
| 010616-S06 | 910 | 3145 | CD8SP-FMC63-scFv-V5-[TCRb-S57C-opt1]-F-P2A-SP-FMC63-scFv-MYC-[TCRa-T48C-opt1]-T2A-Pac |
| 051216-E05 | 911 | 3146 | CD8SP-FMC63-vL-Gly-Ser-Linker-FMC63-vH-V5-[hTCRb-WT]-F-P2A-PAC |
| 051216-G01 | 912 | 3147 | CD8SP-FMC63-vL-Gly-Ser-Linker-FMC63-vH-V5-[hTCRb-S57C-opt]-F-P2A-PAC |
| 050216-S08 & 050216-T02 | 913 | 3148 | CD8SP-FMC63-vL-V5-[hTCRb-KACIAH]-F-P2A-PAC |
| 060816-J02 | 914 | 3149 | CD8SP-FMC63-vL-Gly-Ser-Linker-FMC63-vH-Myc-[preTCRa-Del48]-F-F2A-PAC |
| 062416-Z07 | 915 | 3150 | CD8SP-FMC63-vL-V5-[hTCRb-KACIAH]-F-P2A-SP-FMC63-vH-Myc-[hTCRa-CSDVP]-F-F2A-CD3z-F-T2A-PAC |
| 052616-X07 | 916 | 3151 | CD8SP-FMC63-vL-V5-[hTCRb-KACIAH]-F-P2A-SP-FMC63-vH-Myc-[hTCRa-CSDVP]-F-F2A-CD3-BBz-F-T2A-PAC |
| 061616-A01 | 917 | 3152 | CD8SP-FMC63-vL-V5-[hTCRb-KACIAH]-F-P2A-SP-FMC63-vH-Myc-[hTCRa-CSDVP]-F-F2A-41BBL-F-T2A-PAC |
| 051216-K04 | 918 | 3153 | CD8SP-FMC63-vL-V5-[hTCRb-KACIAH]-F-P2A-SP-FMC63-vH-Myc-[hTCRa-CSDVP]-F-F2A-K13-FLAG-F-T2A-PAC |
| 051716-I08 | 919 | 3154 | CD8SP-FMC63-vL-V5-[hTCRb-KACIAH]-F-P2A-SP-FMC63-vH-Myc-[hTCRa-CSDVP]-F-F2A-CD3z-GGGS-41BB-F-T2A-PAC |
| 022216-A04 | 920 | 3155 | CD8SP-FMC63-vL-V5-[hTCRb-KACIAH]-F-P2A-SP-FMC63-vH-Myc-[hTCRa-CSDVP]-F-F2A-K13-FLAG-F-T2A-CNB30 |
| 060116-E02 | 921 | 3156 | CD8SP-FMC63-vL-V5-[hTCRb-KACIAH]-F-P2A-SP-FMC63-vH-Myc-[hTCRa-CSDVP]-F-F2A-CXCR4-1-VHH-LAILR1 |

TABLE 7F-continued

Exemplary SIR Constructs Targeting CD19
with FMC63 Based Binding Domain(s)

| Clone ID | SEQ ID-DNA | SEQ ID-PRT | NAME |
|---|---|---|---|
| 080815-F02 | 922 | 3157 | CD8SP-FMC63-vL-V5-[hTCRb-WT]-F-P2A-SP-FMC63-vH-Myc-[hTCRa-WT]-F-F2A-PAC |
| | 923 | 3158 | CD8SP-FMC63-vL-V5-[hTCRb-WT]-F-P2A-SP-FMC63-vH-Myc-[hTCRa-T48C-opt]-F-F2A-PAC |
| | 924 | 3159 | CD8SP-FMC63-vL-V5-[hTCRb-WT]-F-P2A-SP-FMC63-vH-[hTCRa-opt2]-F-F2A-PAC |
| | 925 | 3160 | CD8SP-FMC63-vL-V5-[hTCRb-WT]-F-P2A-SP-FMC63-vH-Myc-[hTCRa-CSDVP]-F-F2A-PAC |
| 091015-Y08 | 926 | 3161 | CD8SP-FMC63-vL-V5-[hTCRb-WT]-F-P2A-SP-FMC63-vH-Myc-[preTCRa-Del48]-F-F2A-PAC |
| 081714-H13 | 927 | 3162 | CD8SP-FMC63-vL-V5-[hTCRb-KACIAH]-F-P2A-SP-FMC63-vH-Myc-[hTCRa-WT]-F-F2A-PAC |
| | 928 | 3163 | CD8SP-FMC63-vL-V5-[hTCRb-KACIAH]-F-P2A-SP-FMC63-vH-Myc-[hTCRa-T48C-opt]-F-F2A-PAC |
| | 929 | 3164 | CD8SP-FMC63-vL-V5-[hTCRb-KACIAH]-F-P2A-SP-FMC63-vH-[hTCRa-opt2]-F-F2A-PAC |
| 102615-C08 & 010616-C01 | 930 | 3165 | CD8SP-FMC63-vL-V5-[hTCRb-KACIAH]-F-P2A-SP-FMC63-vH-Myc-[hTCRa-CSDVP]-F-F2A-PAC |
| 063016-B03 | 931 | 3166 | CD8SP-FMC63-vL-MYC2-[hTCRb-KACIAH]-F-P2A-SP-FMC63-vH-Myc4-[hTCRa-CSDVP]-F-F2A-PAC |
| | 932 | 3167 | CD8SP-FMC63-vL-[hTCRb-KAIAH]-F-P2A-SP-FMC63-vH-Myc-[hTCRa-SDVP]-F-F2A-PAC |
| | 933 | 3168 | CD8SP-FMC63-vL-[hTCRb-KA]-F-P2A-SP-FMC63-vH-Myc-[hTCRa-SDVP]-F-F2A-PAC |
| | 934 | 3169 | CD8SP-FMC63-vL-[hTCRb-KAIAHG]-F-P2A-SP-FMC63-vH-Myc-[hTCRa-SDVPR]-F-F2A-PAC |
| | 935 | 3170 | CD8SP-FMC63-vL-[hTCRb-KAG]-F-P2A-SP-FMC63-vH-Myc-[hTCRa-SDVPR]-F-F2A-PAC |
| 052316-F01 | 936 | 3171 | CD8SP-FMC63-vL-V5-[hTCRb-KACIAH]-F-P2A-SP-FMC63-vH-Myc4-[hTCRa-CSDVP]-F-F2A-PAC |
| 060816-K08 | 937 | 3172 | CD8SP-FMC63-vL-Myc2-[hTCRb-R79G-opt]-F-P2A-SP-FMC63-vH-Myc4-[hTCRa-S61R-opt]-F-F2A-PAC |
| 053116-G03 | 938 | 3173 | CD8SP-FMC63-vL-Streptag-[hTCRb-R79G]-F-P2A-SP-FMC63-vH-Myc4-[hTCRa-S61R]-F-F2A-PAC |
| 031516-J07 | 939 | 3174 | CD8SP-FMC63-vL-[hTCRb-opt3]-F-P2A-SP-FMC63-vH-[hTCRa-opt3]-F-F2A-PAC |
| 031516-K04 | 940 | 3175 | CD8SP-FMC63-vL-[hTCRb-opt4]-F-P2A-SP-FMC63-vH-[hTCRa-opt3]-F-F2A-PAC |
| | 941 | 3176 | CD8SP-FMC63-vL-V5-[hTCRb-KACIAH]-F-P2A-SP-FMC63-vH-Myc-[preTCRa]-F-F2A-PAC |
| 082815-Q08 | 942 | 3177 | CD8SP-FMC63-vL-V5-[hTCRb-KACIAH]-F-P2A-SP-FMC63-vH-Myc-[preTCRa-Del48]-F-F2A-PAC |
| | 943 | 3178 | CD8SP-FMC63-vL-[hTCRb-opt2]-F-P2A-SP-FMC63-vH-Myc-[hTCRa-WT]-F-F2A-PAC |
| | 944 | 3179 | CD8SP-FMC63-vL-[hTCRb-opt2]-F-P2A-SP-FMC63-vH-Myc-[hTCRa-T48C-opt]-F-F2A-PAC |
| 020116-W03 & 020416-C03 | 945 | 3180 | CD8SP-FMC63-vL-[hTCRb-opt2]-F-P2A-SP-FMC63-vH-[hTCRa-opt2]-F-F2A-PAC |
| | 946 | 3181 | CD8SP-FMC63-vL-[hTCRb-opt2]-F-P2A-SP-FMC63-vH-Myc-[hTCRa-CSDVP]-F-F2A-PAC |
| | 947 | 3182 | CD8SP-FMC63-vL-[hTCRb-opt2]-F-P2A-SP-FMC63-vH-Myc-[preTCRa]-F-F2A-PAC |
| | 948 | 3183 | CD8SP-FMC63-vL-[hTCRb-opt2]-F-P2A-SP-FMC63-vH-Myc-[preTCRa-Del48]-F-F2A-PAC |
| 091015-A06 & 010616-B04 | 949 | 3184 | CD8SP-FMC63-vL-V5-[hTCRg-opt]-F-P2A-SP-FMC63-vH-Myc-[hTCRd-opt]-F-F2A-PAC |
| 111915-R05 | 950 | 3185 | CD8SP-FMC63-vL-V5-[hTCRb-S57C-opt]-F-P2A-SP-FMC63-vH-Myc-[hTCRd-opt]-F-F2A-PAC |
| 100815-B04 | 951 | 3186 | CD8SP-FMC63-vL-V5-[hTCRb-S57C-opt]-F-P2A-SP-FMC63-vH-Myc-[hTCRa-T48C-opt]-F-F2A-PAC |
| 111915-S05 & 040416-E02 | 952 | 3187 | CD8SP-FMC63-vL-V5-[hTCRg-opt]-F-P2A-SP-FMC63-vH-Myc-[hTCRa-T48C-opt]-F-F2A-PAC |

TABLE 7F-continued

Exemplary SIR Constructs Targeting CD19 with FMC63 Based Binding Domain(s)

| Clone ID | SEQ ID-DNA | SEQ ID-PRT | NAME |
|---|---|---|---|
| 080815-B06 | 953 | 3188 | CD8SP-FMC63-vL-V5-[mTCRb-opt]-F-P2A-SP-FMC63-vH-Myc-[mTCRa-opt]-F-F2A-PAC |
|  | 954 | 3189 | CD8SP-FMC63-vL-[canine-TCRb-opt]-F-P2A-SP-FMC63-vH-[canine-TCRa-opt]-F-F2A-PAC |
| 053116-E04 & 060116-C01 | 955 | 3190 | CD8SP-FMC63-vL-G4Sx2-[hTCRa-S61R-opt]-F-F2A-FMC63-vH-G4Sx2-[hTCRb-R79G-opt]-F-P2A-PAC |
| 060116 F04 | 956 | 3191 | CD8SP-FMC63-vL-V5-[hTCRb-KACIAH]-F-P2A-SP-FMC63-vH-Myc-[hTCRa-CSDVP]-F-F2A-K13-FLAG |
| 071316-A06 | 957 | 3192 | CD8SP-FMC63-vL-V5-[hTCRb-KACIAH]-F-P2A-SP-FMC63-vH-Myc-[hTCRa-CSDVP]-F-F2A-41BB-L |
| 052616-E03 | 958 | 3193 | CD8SP-FMC63-vL-V5-[hTCRb-KACIAH]-F-P2A-SP-FMC63-vH-Myc-[hTCRa-CSDVP]-F-F2A-CD3-BBz |
| 051216-A01 | 959 | 3194 | CD8SP-FMC63-vL-V5-[hTCRb-KACIAH]-F-P2A-SP-FMC63-vH-Myc-[hTCRa-CSDVP]-F-F2A-CD3z-GGGS-41BB |
| 071316-B06 | 960 | 3195 | CD8SP-FMC63-vL-V5-[hTCRb-KACIAH]-F-P2A-SP-FMC63-vH-Myc-[hTCRa-CSDVP]-F-F2A-CD3z |
|  | 961 | 3196 | CD8SP-FMC63-vL-V5-[hTCRb-KACIAH]-F-P2A-SP-FMC63-vH-Myc-[hTCRa-CSDVP]-F-F2A-CD40L- |
|  | 962 | 3197 | CD8SP-FMC63-vL-V5-[hTCRb-KACIAH]-F-P2A-SP-FMC63-vH-Myc-[hTCRa-CSDVP]-F-F2A-cFLIP-p22-FLAG |
|  | 963 | 3198 | CD8SP-FMC63-vL-V5-[hTCRb-KACIAH]-F-P2A-SP-FMC63-vH-Myc-[hTCRa-CSDVP]-F-F2A-FKBP-K13-FLAG |
|  | 964 | 3199 | CD8SP-FMC63-vL-V5-[hTCRb-KACIAH]-F-P2A-SP-FMC63-vH-Myc-[hTCRa-CSDVP]-F-F2A-FKBPX2-K13-FLAG |
|  | 965 | 3200 | CD8SP-FMC63-vL-V5-[hTCRb-KACIAH]-F-P2A-SP-FMC63-vH-Myc-[hTCRa-CSDVP]-F-F2A-HTLV2-TAX |
|  | 966 | 3201 | CD8SP-FMC63-vL-V5-[hTCRb-KACIAH]-F-P2A-SP-FMC63-vH-Myc-[hTCRa-CSDVP]-F-F2A-HTLV2-TAX-RS |
|  | 967 | 3202 | CD8SP-FMC63-vL-V5-[hTCRb-KACIAH]-F-P2A-SP-FMC63-vH-Myc-[hTCRa-CSDVP]-F-F2A-icasapase9 |
|  | 968 | 3203 | CD8SP-FMC63-vL-V5-[hTCRb-KACIAH]-F-P2A-SP-FMC63-vH-Myc-[hTCRa-CSDVP]-F-F2A-IGHSP2-IL6R-304-VHH-ALB8-VHH |
|  | 969 | 3204 | CD8SP-FMC63-vL-V5-[hTCRb-KACIAH]-F-P2A-SP-FMC63-vH-Myc-[hTCRa-CSDVP]-F-F2A-IL12F |
|  | 970 | 3205 | CD8SP-FMC63-vL-V5-[hTCRb-KACIAH]-F-P2A-SP-FMC63-vH-Myc-[hTCRa-CSDVP]-F-F2A-MC159L-FLAG |
|  | 971 | 3206 | CD8SP-FMC63-vL-V5-[hTCRb-KACIAH]-F-P2A-SP-FMC63-vH-Myc-[hTCRa-CSDVP]-F-F2A-CD8SP2-PD1-4H1-scFv |
|  | 972 | 3207 | CD8SP-FMC63-vL-V5-[hTCRg-opt]-F-P2A-SP-FMC63-vH-Myc-[hTCRd-opt]-F-F2A-CD8SP2-PD1-4H1-scFv |
|  | 973 | 3208 | CD8SP-FMC63-vL-V5-[hTCRb-KACIAH]-F-P2A-SP-FMC63-vH-Myc-[hTCRa-CSDVP]-F-F2A-CD8SP2-PD1-5C4-scFv |
|  | 974 | 3209 | CD8SP-FMC63-vL-V5-[hTCRb-KACIAH]-F-P2A-SP-FMC63-vH-Myc-[hTCRa-CSDVP]-F-F2A-tEGFRviii |
|  | 975 | 3210 | CD8SP-FMC63-vL-V5-[hTCRb-KACIAH]-F-P2A-SP-FMC63-vH-Myc-[hTCRa-CSDVP]-F-F2A-GMCSF-SP-tEGFR |
|  | 976 | 3211 | CD8SP-FMC63-vL-V5-[hTCRb-KACIAH]-F-P2A-SP-FMC63-vH-Myc-[hTCRa-CSDVP]-F-F2A-tCD19 |
|  | 977 | 3212 | CD8SP-FMC63-vL-V5-[hTCRb-KACIAH]-F-P2A-SP-FMC63-vH-Myc-[hTCRa-CSDVP]-F-F2A-tBCMA |
|  | 978 | 3213 | CD8SP-FMC63-vL-V5-[hTCRb-KACIAH]-F-P2A-SP-FMC63-vH-Myc-[hTCRa-CSDVP]-F-F2A-CD8SP2-PD1-4H1-Alb8-vHH |
|  | 979 | 3214 | CD8SP-FMC63-vL-V5-[hTCRb-KACIAH]-F-P2A-SP-FMC63-vH-Myc-[hTCRa-CSDVP]-F-F2A-Myr-MYD88-CD40-FV'-FV |
|  | 980 | 3215 | CD8SP-FMC63-vL-V5-[hTCRb-KACIAH]-F-P2A-SP-FMC63-vH-Myc-[hTCRa-CSDVP]-F-F2A-CD8SP2-Ipilimumab-scFv |
|  | 981 | 3216 | CD8SP-FMC63-vL-V5-[hTCRb-KACIAH]-F-P2A-SP-FMC63-vH-Myc-[hTCRa-CSDVP]-F-F2A-CD8SP2-Ipilimumab-Alb8-vHH |

TABLE 7F-continued

Exemplary SIR Constructs Targeting CD19
with FMC63 Based Binding Domain(s)

| Clone ID | SEQ ID-DNA | SEQ ID-PRT | NAME |
|---|---|---|---|
| | | 982 | 3217 | CD8SP-FMC63-vL-V5-[hTCRb-KACIAH]-F-P2A-SP-FMC63-vH-Myc-[hTCRa-CSDVP]-F-F2A-SP-PD1-ECD-opt-CD8TM-BB |
| | 983 | 3218 | CD8SP-FMC63-vL-V5-[hTCRb-KACIAH]-F-P2A-SP-FMC63-vH-Myc-[hTCRa-CSDVP]-F-F2A-SP-PD1-ECD-opt-CD8TM-BBZ |
| | 984 | 3219 | CD8SP-FMC63-vL-V5-[hTCRb-KACIAH]-F-P2A-SP-FMC63-vH-Myc-[hTCRa-CSDVP]-F-F2A-SP-PD1-ECD-CD8TM-BBZ |
| | 985 | 3220 | CD8SP-FMC63-vL-V5-[hTCRb-KACIAH]-F-P2A-SP-FMC63-vH-Myc-[hTCRa-CSDVP]-F-F2A-SP-CD123-2-vHH-LAILR1-TM-CP |
| | 986 | 3221 | CD8SP-FMC63-vL-V5-[hTCRb-KACIAH]-F-P2A-SP-FMC63-vH-Myc-[hTCRa-CSDVP]-F-F2A-SP-CTLA4-ECD-opt-CD8TM-BB |
| | 987 | 3222 | CD8SP-FMC63-vL-V5-[hTCRb-KACIAH]-F-P2A-SP-FMC63-vH-Myc-[hTCRa-CSDVP]-F-F2A-SP-CTLA4-ECD-opt-CD8TM-BBZ |
| 060716-H02 | 988 | 3223 | CD8SP-V5-[hTCRb-KACIAH]-F-P2A-SP-FMC63-scFv-Myc4-[hTCRa-CSDVP]-F-F2A-PAC |
| 082815-J02 & 010616-X02 | 989 | 3224 | CD8SP-V5-[hTCRb-KACIAH]-F-P2A-SP-FMC63-scFv-Myc-[hTCRa-WT]-F-F2A-PAC |
| 061416-U04 | 990 | 3225 | CD8SP-[hTCRb-opt2]-F-P2A-SP-FMC63-scFv-vH-Myc-[preTCRa-Del48]-F-F2A-PAC |
| 021816-O05 | 991 | 3226 | CD8SP-FMC63-vL-Gly-Ser-Linker-FMC63-vH-V5-[hTCRb-S57C-opt]-F-P2A-SP-Myc-[hTCRa-T48C-opt]-F-F2A-PAC |
| 081415-D06 | 992 | 3227 | CD8SP-FMC63-vL-V5-[hTCRb-KACIAH]-F-P2A-SP-FMC63-vH-Myc-[hTCRa-CSDVP]-F-F2A-PAC |
| | 993 | 3228 | CD8SP-FMC63-vL-V5-[hTCRb-KACIAH]-F-P2A-SP-FMC63-vH-Myc-[hTCRa-CSDVP]-F-F2A-CD8SP2-sHVEM |
| | 994 | 3229 | CD8SP-FMC63-vL-V5-[hTCRb-KACIAH]-F-P2A-SP-FMC63-vH-Myc-[hTCRa-CSDVP]-F-F2A-CD8SP2-sHVEM-Alb8-vHH |
| 092515-R04 | 995 | 3230 | CD8SP-FMC63-vL-V5-[hTCRg1-opt]-F-P2A-SP-FMC63vH-V5-[hTCRb-S57C-Opt1]-PAC |
| 031516-K07 | 996 | 3231 | |
| 041916-B03 & 041916-A02 | 997 | 3232 | IgHSP-FMC63-vH-MYC-[hTCRa-CSDVP]-F-F2A-BlastR |
| 031416-A18 | 998 | 3233 | CD8SP-FMC63-vL-V5-[hTCRb-KACIAH]-F-P2A-SP-FMC63vH-MYC-[hTCRa-CSDVP]-F-F2A-CD3z-41BB-T2A-CNB30 |
| 063016-D01 | 999 | 3234 | CD8SP-V5-[hTCRb-KACIAH]-F-P2A-FMC63-vH-StreptagII-[hTCRa-CSDVP]-F-F2A-Pac |
| 111915-T04 | 1000 | 3235 | CD8SP-FMC63-vL-V5-[hTCRb-S57C-opt]-F-P2A-SP-FMC63-vH-Myc-[preTCRa-Del48]-F-F2A-PAC |

TABLE 7G

Exemplary SIRs Targeting CD19 Based On Bu12 Binding Domain

| TARGET | CLONE ID | SEQ ID-DNA | SEQ ID (PRT) | NAME |
|---|---|---|---|---|
| CD19 | 042616-C01 | 1015 | 3250 | CD8SP-CD19Bu12-scFv-V5-[hTCRg-opt]-F-P2A-SP-Myc-[hTCRd-opt]-F-F2A-PAC |
| CD19 | 021816-N02 | 1016 | 3251 | CD8SP-CD19Bu12-scFv-V5-[hTCRb-S57C-opt]-F-P2A-SP-Myc-[hTCRa-T48C-opt]-F-F2A-PAC |
| CD19 | 052316-D03 | 1017 | 3252 | CD8SP-CD19Bu12-scFv-[hTCRb-opt2]-F-P2A-SP-Myc-[hTCRa-T48C-opt]-F-F2A-PAC |
| CD19 | 121515-X07 | 1018 | 3253 | CD8SP-V5-[hTCRb-KACIAH]-F-P2A-SP-CD19Bu12-scFv-Myc-[preTCRa-Del48]-F-F2A-PAC |

TABLE 7G-continued

Exemplary SIRs Targeting CD19 Based On Bu12 Binding Domain

| TARGET | CLONE ID | SEQ ID-DNA | SEQ ID (PRT) | NAME |
|---|---|---|---|---|
| CD19 | 031616-B05 | 1019 | 3254 | CD8SP-CD19Bu12-scFv-V5-[hTCRb-KACIAH]-F-P2A-SP-Myc-[hTCRa-T48C-opt]-F-F2A-PAC |
| CD19 | 031616-C05 | 1020 | 3255 | CD8SP-CD19BU12-V5-[hTCRb-KACIAH]-F-P2A-SP-Myc-[hTCRa-CSDVP]-F-F2A-PAC |
| CD19 | 070215-M03 | 1021 | 3256 | CD8SP-CD19Bu12-vL-V5-[TCRb-S57C-opt1]-F-P2A-SP-CD19Bu12-vH-Myc-[TCRa-T48C-opt1]-F-F2A-PAC |
| CD19 | 051216-D08 | 1022 | 3257 | CD8SP-CD19Bu12-scFv-V5-[hTCRb-WT]-F-P2A-PAC |
| CD19 | 051216-F04 | 1023 | 3258 | CD8SP-CD19Bu12-scFv-V5-[hTCRb-S57C-opt]-F-P2A-PAC |
| CD19 | 052316-J03 | 1024 | 3259 | CD8SP-CD19Bu12-scFv-Myc-[hTCRa-WT]-F-F2A-PAC |
| CD19 | 060816-H05 | 1025 | 3260 | CD8SP-CD19Bu12-scFv-Myc-[preTCRa-Del48]-F-F2A-PAC |
| CD19 | 020216-B07 | 1026 | 3261 | CD8SP-CD19Bu12-scFv-V5-[hTCRb-KACIAH]-F-P2A-SP-FMC63-scFv-Myc-[hTCRa-CSDVP]-F-F2A-PAC |
| CD19 | 021916-W03 | 1027 | 3262 | CD8SP-CD19Bu12-scFv-V5-[hTCRb-KACIAH]-F-P2A-SP-CD19MM-scFv-Myc-[hTCRa-CSDVP]-F-F2A-PAC |
| CD19 & CD20 | 040716-B04 | 1028 | 3263 | CD8SP-CD19Bu12-scFv-V5-[hTCRb-KACIAH]-F-P2A-SP-CD20-2F2-scFv-Myc-[hTCRa-CSDVP]-F-F2A-PAC |
| CD19 & CD30 | 041216-C02 | 1029 | 3264 | CD8SP-CD19Bu12-scFv-[hTCRb-KACIAH]-F-P2A-CD8SP-CD30-5F11-scFv-Myc-[hTCRa-CSDVP]-F-F2A-PAC |
| CD19 & CD79b | 040716-I04 | 1030 | 3265 | CD8SP-CD19Bu12-scFv-[hTCRb-KACIAH]-F-P2A-CD8SP-CD79b-2F2-scFv-Myc-[hTCRa-CSDVP]-F-F2A-PAC |
| CD19 & CD123 | 040716-E01 | 1031 | 3266 | CD8SP-CD19Bu12-scFv-[hTCRb-KACIAH]-F-P2A-CD8SP-CD123-CSL362-scFv-Myc-[hTCRa-CSDVP]-F-F2A-PAC |
| CD19 & CD123 | 041216-G04 | 1032 | 3267 | CD8SP-CD19Bu12-scFv-[hTCRb-KACIAH]-F-P2A-IgHSP-CD123-1-scFv-Myc-[hTCRa-CSDVP]-F-F2A-PAC |
| CD19 & CD138 | 041216-D05 | 1033 | 3268 | CD8SP-CD19Bu12-scFv-[hTCRb-KACIAH]-F-P2A-CD8SP-CD138-scFv-Myc-[hTCRa-CSDVP]-F-F2A-PAC |
| CD19 & Lym1 | 041216-F04 | 1034 | 3269 | CD8SP-CD19Bu12-scFv-[hTCRb-KACIAH]-F-P2A-CD8SP-Lym1-scFv-Myc-[hTCRa-CSDVP]-F-F2A-PAC |
| CD19 & CLL1 | 040716-F05 | 1035 | 3270 | CD8SP-CD19Bu12-scFv-[hTCRb-KACIAH]-F-P2A-CD8SP-CLL1-M26-scFv-Myc-[hTCRa-CSDVP]-F-F2A-PAC |
| CD19 & CLL1 | 040716-G02 | 1036 | 3271 | CD8SP-CD19Bu12-scFv-[hTCRb-KACIAH]-F-P2A-CD8SP-CLL1-M32-scFv-Myc-[hTCRa-CSDVP]-F-F2A-PAC |
| CD19 | 041816-F02 | 1037 | 3272 | CD8SP-CD19Bu12-scFv-V5-[hTCRb-KACIAH]-F-P2A-SP-CD19MM-scFv-Myc-[preTCRa-Del48]-F-F2A-PAC |
| CD19 | 021916-Q03 | 1038 | 3273 | CD8SP-CD19Bu12-vL-V5-[hTCRb-WT]-F-P2A-CD19Bu12-vH-Myc-[hTCRa-WT]-F-F2A-PAC |
| CD19 | | 1039 | 3274 | CD8SP-CD19Bu12-vL-V5-[hTCRb-KACIAH]-F-P2A-CD19Bu12-vH-Myc-[hTCRa-WT]-F-F2A-PAC |
| CD19 | | 1040 | 3275 | CD8SP-CD19Bu12-vL-V5-[hTCRb-KACIAH]-F-P2A-CD19Bu12-vH-Myc-[hTCRa-T48C-opt]-F-F2A-PAC |
| CD19 | | 1041 | 3276 | CD8SP-CD19Bu12-vL-V5-[hTCRb-KACIAH]-F-P2A-CD19Bu12-vH-[hTCRa-opt2]-F-F2A-PAC |
| CD19 | | 1042 | 3277 | CD8SP-CD19Bu12-vL-V5-[hTCRb-KACIAH]-F-P2A-CD19Bu12-vH-Myc-[hTCRa-CSDVP]-F-F2A-PAC |
| CD19 | | 1043 | 3278 | CD8SP-CD19Bu12-vL-MYC2-[hTCRb-KACIAH]-F-P2A-CD19Bu12-vH-Myc-[hTCRa-CSDVP]-F-F2A-PAC |
| CD19 | | 1044 | 3279 | CD8SP-CD19Bu12-vL-[hTCRb-KAIAH]-F-P2A-CD19Bu12-vH-Myc-[hTCRa-SDVP]-F-F2A-PAC |
| CD19 | | 1045 | 3280 | CD8SP-CD19Bu12-vL-[hTCRb-KA]-F-P2A-CD19Bu12-vH-Myc-[hTCRa-SDVP]-F-F2A-PAC |
| CD19 | | 1046 | 3281 | CD8SP-CD19Bu12-vL-[hTCRb-KAIAHG]-F-P2A-CD19Bu12-vH-Myc-[hTCRa-SDVPR]-F-F2A-PAC |

TABLE 7G-continued

Exemplary SIRs Targeting CD19 Based On Bu12 Binding Domain

| TARGET | CLONE ID | SEQ ID-DNA | SEQ ID (PRT) | NAME |
|---|---|---|---|---|
| CD19 | | 1047 | 3282 | CD8SP-CD19Bu12-vL-[hTCRb-KAG]-F-P2A-CD19Bu12-vH-Myc-[hTCRa-SDVPR]-F-F2A-PAC |
| CD19 | | 1048 | 3283 | CD8SP-CD19Bu12-vL-V5-[hTCRb-KACIAH]-F-P2A-CD19Bu12-vH-Myc4-[hTCRa-CSDVP]-F-F2A-PAC |
| CD19 | | 1049 | 3284 | CD8SP-CD19Bu12-vL-Myc2-[hTCRb-R79G-opt]-F-P2A-CD19Bu12-vH-Myc4-[hTCRa-S61R-opt]-F-F2A-PAC |
| CD19 | | 1050 | 3285 | CD8SP-CD19Bu12-vL-Streptag-[hTCRb-R79G]-F-P2A-CD19Bu12-vH-Myc4-[hTCRa-S61R]-F-F2A-PAC |
| CD19 | | 1051 | 3286 | CD8SP-CD19Bu12-vL-[hTCRb-opt3]-F-P2A-CD19Bu12-vH-[hTCRa-opt3]-F-F2A-PAC |
| CD19 | | 1052 | 3287 | CD8SP-CD19Bu12-vL-[hTCRb-opt4]-F-P2A-CD19Bu12-vH-[hTCRa-opt3]-F-F2A-PAC |
| CD19 | | 1053 | 3288 | CD8SP-CD19Bu12-vL-V5-[hTCRb-KACIAH]-F-P2A-CD19Bu12-vH-Myc-[preTCRa]-F-F2A-PAC |
| CD19 | | 1054 | 3289 | CD8SP-CD19Bu12-vL-V5-[hTCRb-KACIAH]-F-P2A-CD19Bu12-vH-Myc-[preTCRa-Del48]-F-F2A-PAC |
| CD19 | | 1055 | 3290 | CD8SP-CD19Bu12-vL-[hTCRb-opt2]-F-P2A-CD19Bu12-vH-Myc-[hTCRa-T48C-opt]-F-F2A-PAC |
| CD19 | 020416-A02 | 1056 | 3291 | CD8SP-CD19Bu12-vL-[hTCRb-opt2]-F-P2A-CD19Bu12-vH-[hTCRa-opt2]-F-F2A-PAC |
| CD19 | | 1057 | 3292 | CD8SP-CD19Bu12-vL-[hTCRb-opt2]-F-P2A-CD19Bu12-vH-Myc-[hTCRa-CSDVP]-F-F2A-PAC |
| CD19 | | 1058 | 3293 | CD8SP-CD19Bu12-vL-[hTCRb-opt2]-F-P2A-CD19Bu12-vH-Myc-[preTCRa]-F-F2A-PAC |
| CD19 | | 1059 | 3294 | CD8SP-CD19Bu12-vL-[hTCRb-opt2]-F-P2A-CD19Bu12-vH-Myc-[preTCRa-Del48]-F-F2A-PAC |
| CD19 | | 1060 | 3295 | CD8SP-CD19Bu12-vL-V5-[hTCRg-opt]-F-P2A-CD19Bu12-vH-Myc-[hTCRd-opt]-F-F2A-PAC |
| CD19 | | 1061 | 3296 | CD8SP-CD19Bu12-vL-V5-[hTCRb-S57C-opt]-F-P2A-CD19Bu12-vH-Myc-[hTCRd-opt]-F-F2A-PAC |
| CD19 | | 1062 | 3297 | CD8SP-CD19Bu12-vL-V5-[hTCRb-S57C-opt]-F-P2A-CD19Bu12-vH-Myc-[hTCRa-T48C-opt]-F-F2A-PAC |
| CD19 | | 1063 | 3298 | CD8SP-CD19Bu12-vL-V5-[hTCRg-opt]-F-P2A-CD19Bu12-vH-Myc-[hTCRa-T48C-opt]-F-F2A-PAC |
| CD19 | | 1064 | 3299 | CD8SP-CD19Bu12-vL-V5-[mTCRb-opt]-F-P2A-CD19Bu12-vH-Myc-[mTCRa-opt]-F-F2A-PAC |
| CD19 | | 1065 | 3300 | CD8SP-CD19Bu12-vL-[canine-TCRb-opt]-F-P2A-CD19Bu12-vH-[canine-TCRa-opt]-F-F2A-PAC |
| CD19 | | 1066 | 3301 | CD8SP-CD19Bu12-vL-G4Sx2-[hTCRa-S61R-opt]-F-F2A-CD19Bu12-vH-G4Sx2-[hTCRb-R79G-opt]-F-P2A-PAC |
| CD19 | | 1067 | 3302 | CD8SP-CD19Bu12-vL-V5-[hTCRb-KACIAH]-F-P2A-CD19Bu12-vH-Myc-[hTCRa-CSDVP]-F-F2A-K13-FLAG |
| CD19 | | 1068 | 3303 | CD8SP-CD19Bu12-vL-V5-[hTCRb-KACIAH]-F-P2A-CD19Bu12-vH-Myc-[hTCRa-CSDVP]-F-F2A-41BB-L |
| CD19 | | 1069 | 3304 | CD8SP-CD19Bu12-vL-V5-[hTCRb-KACIAH]-F-P2A-CD19Bu12-vH-Myc-[hTCRa-CSDVP]-F-F2A-CD3-BBz |
| CD19 | | 1070 | 3305 | CD8SP-CD19Bu12-vL-V5-[hTCRb-KACIAH]-F-P2A-CD19Bu12-vH-Myc-[hTCRa-CSDVP]-F-F2A-CD3z-GGGS-41BB |
| CD19 | | 1071 | 3306 | CD8SP-CD19Bu12-vL-V5-[hTCRb-KACIAH]-F-P2A-CD19Bu12-vH-Myc-[hTCRa-CSDVP]-F-F2A-CD3z |
| CD19 | | 1072 | 3307 | CD8SP-CD19Bu12-vL-V5-[hTCRb-KACIAH]-F-P2A-CD19Bu12-vH-Myc-[hTCRa-CSDVP]-F-F2A-CD40L- |
| CD19 | | 1073 | 3308 | CD8SP-CD19Bu12-vL-V5-[hTCRb-KACIAH]-F-P2A-CD19Bu12-vH-Myc-[hTCRa-CSDVP]--F-F2A-cFLIP-L/MRIT-alpha-FLAG |

TABLE 7G-continued

Exemplary SIRs Targeting CD19 Based On Bu12 Binding Domain

| TARGET | CLONE ID | SEQ ID-DNA | SEQ ID (PRT) | NAME |
|---|---|---|---|---|
| CD19 | | 1074 | 3309 | CD8SP-CD19Bu12-vL-V5-[hTCRb-KACIAH]-F-P2A-CD19Bu12-vH-Myc-[hTCRa-CSDVP]-F-F2A-cFLIP-p22-FLAG |
| CD19 | | 1075 | 3310 | CD8SP-CD19Bu12-vL-V5-[hTCRb-KACIAH]-F-P2A-CD19Bu12-vH-Myc-[hTCRa-CSDVP]-F-F2A-FKBP-K13-FLAG |
| CD19 | | 1076 | 3311 | CD8SP-CD19Bu12-vL-V5-[hTCRb-KACIAH]-F-P2A-CD19Bu12-vH-Myc-[hTCRa-CSDVP]-F-F2A-FKBPX2-K13-FLAG |
| CD19 | | 1077 | 3312 | CD8SP-CD19Bu12-vL-V5-[hTCRb-KACIAH]-F-P2A-CD19Bu12-vH-Myc-[hTCRa-CSDVP]-F-F2A-HTLV1-TAX |
| CD19 | | 1078 | 3313 | CD8SP-CD19Bu12-vL-V5-[hTCRb-KACIAH]-F-P2A-CD19Bu12-vH-Myc-[hTCRa-CSDVP]-F-F2A-HTLV2-TAX |
| CD19 | | 1079 | 3314 | CD8SP-CD19Bu12-vL-V5-[hTCRb-KACIAH]-F-P2A-CD19Bu12-vH-Myc-[hTCRa-CSDVP]-F-F2A-HTLV2-TAX-RS |
| CD19 | | 1080 | 3315 | CD8SP-CD19Bu12-vL-V5-[hTCRb-KACIAH]-F-P2A-CD19Bu12-vH-Myc-[hTCRa-CSDVP]-F-F2A-icasapase9 |
| CD19 | | 1081 | 3316 | CD8SP-CD19Bu12-vL-V5-[hTCRb-KACIAH]-F-P2A-CD19Bu12-vH-Myc-[hTCRa-CSDVP]-F-F2A-IGHSP2-IL6R-304-VHH-ALB8-VHH |
| CD19 | | 1082 | 3317 | CD8SP-CD19Bu12-vL-V5-[hTCRb-KACIAH]-F-P2A-CD19Bu12-vH-Myc-[hTCRa-CSDVP]-F-F2A-IL12F |
| CD19 | | 1083 | 3318 | CD8SP-CD19Bu12-vL-V5-[hTCRb-KACIAH]-F-P2A-CD19Bu12-vH-Myc-[hTCRa-CSDVP]-F-F2A-MC159L-FLAG |
| CD19 | | 1084 | 3319 | CD8SP-CD19Bu12-vL-V5-[hTCRb-KACIAH]-F-P2A-CD19Bu12-vH-Myc-[hTCRa-CSDVP]-F-F2A-CD8SP2-PD1-4H1-scFv |
| CD19 | | 1085 | 3320 | CD8SP-CD19Bu12-vL-V5-[hTCRb-KACIAH]-F-P2A-CD19Bu12-vH-Myc-[hTCRa-CSDVP]-F-F2A-CD8SP2-PD1-5C4-scFv |
| CD19 | | 1086 | 3321 | CD8SP-CD19Bu12-vL-V5-[hTCRb-KACIAH]-F-P2A-CD19Bu12-vH-Myc-[hTCRa-CSDVP]-F-F2A-tEGFRviii |
| CD19 | | 1087 | 3322 | CD8SP-CD19Bu12-vL-V5-[hTCRb-KACIAH]-F-P2A-CD19Bu12-vH-Myc-[hTCRa-CSDVP]-F-F2A-GMCSF-SP-tEGFR |
| CD19 | | 1088 | 3323 | CD8SP-CD19Bu12-vL-V5-[hTCRb-KACIAH]-F-P2A-CD19Bu12-vH-Myc-[hTCRa-CSDVP]-F-F2A-tBCMA |
| CD19 | | 1089 | 3324 | CD8SP-CD19Bu12-vL-V5-[hTCRb-KACIAH]-F-P2A-CD19Bu12-vH-Myc-[hTCRa-CSDVP]-F-F2A-CD8SP2-PD1-4H1-Alb8-vHH |
| CD19 | | 1090 | 3325 | CD8SP-CD19Bu12-vL-[hTCRb-opt2]-F-P2A-CD19Bu12-vH-Myc-[preTCRa-Del48]-F-F2A-CD8SP2-PD1-5C4-Alb8-vHH |
| CD19 | | 1091 | 3326 | CD8SP-CD19Bu12-vL-V5-[hTCRb-KACIAH]-F-P2A-CD19Bu12-vH-Myc-[hTCRa-CSDVP]-F-F2A-Myr-MYD88-CD40-FV'-FV |
| CD19 | | 1092 | 3327 | CD8SP-CD19Bu12-vL-V5-[hTCRbECD-CD3zECDTMCP-opt]-F-P2A-CD19Bu12-vH-Myc4-[hTCRaECD-CD3zECDTMCP-opt2]-F-F2A-PAC |
| CD19 | | 1093 | 3328 | CD8SP-V5-[hTCRbECD-CD3zECDTMCP-opt]-F-P2A-SP-CD19Bu12-scFv-Myc4-[hTCRaECD-CD3zECDTMCP-opt2]-F-F2A-PAC |
| CD19 | | 1094 | 3329 | CD8SP-CD19Bu12-scFv-V5-[hTCRbECD-CD3zECDTMCP-opt]]-F-P2A-SP-Myc4-[hTCRaECD-CD3zECDTMCP]-F-F2A-PAC |
| CD19 | 040416-D03 | 1095 | 3330 | CD8SP-CD19Bu12-scFv-V5-[hTCRb-S57C-opt]-F-P2A-SP-Myc-[preTCRa-Del48]-F-F2A-PAC |
| CD19 | 040416-C01 | 1096 | 3331 | CD8SP-CD19Bu12-scFv-V5-[hTCRb-KACIAH]-F-P2A-SP-Myc-[preTCRa-Del48]-F-F2A-PAC |
| CD19 & CD22 | 040716-D01 | 1097 | 3332 | CD8SP-CD19Bu12-scFv-V5-[hTCRb-KACIAH]-F-P2A-SP-CD22-m971-scFv-Myc-[hTCRa-CSDVP]-F-F2A-PAC |
| CD19 | 092515-Y08 | 1098 | 3333 | CD8SP-CD19-Bu12-scFv-AcV5-[hTCRb-3Cs]-F-P2A-FMC63-vL-MYC-[hTCRa-3Cs]-PAC |

TABLE 7G-continued

Exemplary SIRs Targeting CD19 Based On Bu12 Binding Domain

| TARGET | CLONE ID | SEQ ID-DNA | SEQ ID (PRT) | NAME |
|---|---|---|---|---|
| CD19 | 082815-H08 | 1099 | 3334 | CD8SP-V5-[hTCRb-KACIAH]-F-P2A-SP-CD19Bu12-scFv-Myc-[hTCRa-WT]-F-F2A-PAC |

TABLE 7H

SIRs Of Different Types Targeting Different Antigens

| TARGET | CLONE ID | SEQ ID-DNA | SEQ ID-PRT | NAME |
|---|---|---|---|---|
| CD19 | 071715-C06 | 1110 | 3345 | CD8SP-CD19MM-vL-V5-[TCRb-S57C-opt1]-F-P2A-SP-CD19MM-vH-Myc-[TCRa-T48C-opt1]-F-F2A-PAC |
| CD19 | 060816-I02 | 1111 | 3346 | CD8SP-2-CD19MM-scFv-Myc-[preTCRa-Del48]-F-F2A-PAC |
| MPL | 040315-U02 | 1112 | 3347 | CD8SP-MPL-161-vL-V5-[TCRb-S57C-opt1]-F-P2A-MPL-161-vH-Myc-[TCRa-T48C-opt1]-F-F2A-PAC |
| CD20 | 051716-E02 | 1113 | 3348 | CD8SP-CD20-2F2-vL-[canine-TCRb-opt]-F-P2A-CD20-2F2-vH-[canine-TCRa-opt]-F-F2A-PAC |
| Dsg3 autoantibody | | 1114 | 3349 | CD8SP-V5-[hTCRb-KACIAH]-F-P2A-CD8SP-Dsg3-ECD-Myc-[hTCRa-CSDVP]-F-F2A-PAC |
| WT1 | 032516-E05 | 1115 | 3350 | CD8SP-WT1-Ab1-vL-V5-[hTCRb-KACIAH]-F-P2A-SP-WT1-Ab1-vH-Myc-[hTCRa-T48C-opt]-F-F2A-Pac |
| WT1 | 041816-Z02 | 1116 | 3351 | CD8SP-WT1-Ab5-vL-V5-[TCRb-S57C-opt]-F-P2A-SP-WT1-Ab5-vH-MYC-[preTCRα-Del48]-F-F2A-PAC |
| WT1 | 032516-F05 | 1117 | 3352 | CD8SP-WT1-Ab5-vL-V5-[hTCRb-KACIAH]-F-P2A-SP-WT1-Ab5-vH-Myc-[hTCRa-T48C-opt]-F-F2A-Pac |
| TCRB2 | | 1118 | 3353 | CD8SP-[hTCRb-opt4]-F-P2A-CD8SP-TCRB2-CP01-E05-scFv-Myc-[hTCRa-CSDVP]-F-F2A-PAC |
| TCRB2 | | 1119 | 3354 | CD8SP-[hTCRb-opt4]-F-P2A-CD8SP-TCRB2-CP01-D05-scFv-Myc-[hTCRa-CSDVP]-F-F2A-PAC |
| TCRB2 | 092116-E02 | 1120 | 3355 | CD8SP-[hTCRb-opt4]-F-P2A-CD8SP-TCRB2-CP01-E05-scFv-Myc4-[preTCRa-Del48]-F-F2A-PAC |
| TCRB2 | 090716-A07 | 1121 | 3356 | CD8SP-[hTCRb-opt4]-F-P2A-CD8SP-TCRB2-CP01-D05-vL-Gly-Ser-Linker-TCRB2-CP01-D05-vH-Myc4-[preTCRa-Del48]-F-F2A-PAC |
| TCRB2 | 090216-W03 | 1122 | 3357 | CD8SP-TCRB2-CP01-E05-scFv-Xho-[TCRb-opt4]-F-P2A-SP-MYC-[hTCRa-CSDVP]-F-F2A-Pac |
| TCRB2 | 090216-Z04 | 1123 | 3358 | CD8SP-TCRB2-CP01-D05-scFv-Xho-[TCRb-opt4]-F-P2A-SP-MYC-[hTCRa-CSDVP]-F-F2A-Pac |
| TCRB2 | 090216-V06 | 1124 | 3359 | CD8SP-TCRB2-CP01-E05-scFv-Xho-[TCRb-opt4]-F-P2A-SP-MYC-[hTCRa-T48C-opt]-F-F2A-Pac |
| TCRB2 | 090216-Y02 | 1125 | 3360 | CD8SP-TCRB2-CP01-D05-scFv-Xho-[TCRb-opt4]-F-P2A-SP-MYC-[hTCRa-T48C-opt]-F-F2A-Pac |
| TCRB2 | 090216-U07 | 1126 | 3361 | CD8SP-TCRB2-CP01-E05-scFv-Xho-[TCRb-opt4]-F-P2A-SP-MYC4-[preTCRa-Del48-F-F2A-Pac |
| TCRB2 | | 1127 | 3362 | CD8SP-TCRB2-CP01-D05-scFv-Xho-[TCRb-opt4]-F-P2A-SP-MYC4-[preTCRa-Del48-F-F2A-Pac |
| TCRB12 | 072816-L06 | 1128 | 3363 | CD8SP-TCRB2-CP01-E05-vL-[hTCRb-opt4]-F-P2A-SP-TCRB2-CP01-E05-vH-Myc-[hTCRa-CSDVP]-F-F2A-PAC |
| TCRB2 | 072816-K06 | 1129 | 3364 | CD8SP-TCRB2-CP01-D05-vL-[TCRb-opt4]-F-P2A-IgHSP-TCRB2-CP01-D05-vH-MYC-[hTCRa-CSDVP]-F-F2A-Pac |

TABLE 7H-continued

SIRs Of Different Types Targeting Different Antigens

| | | | |
|---|---|---|---|
| CD79b | 041216-H05 | 1130 | 3365 CD8SP-CD79b-2F2-vL-V5-[hTCRb-S57C-opt]-F-P2A-SP-CD79b-2F2-vH-Myc-[preTCRa-Del48]-F-F2A-PAC |
| CD123 | 041416-V03 | 1131 | 3366 IgHSP-CD123-2-vHH-V5-[hTCRb-S57C-opt]-F-P2A-SP-CD123-1-vHH-Myc-[preTCRa-Del48]-F-F2A-PAC |
| CD123 and Ig Fc | 041916-S02 | 1132 | 3367 IgHSP-CD123-2-vHH-V5-[hTCRb-S57C-opt]-F-P2A-CD8SP1-CD16A-V158-ECD-v1-Myc-[preTCRa-Del48]-F-F2A-PAC |
| CD123 and Ig Fc | 041916-R03 | 1133 | 3368 IgHSP-CD123-2-vHH-V5-[hTCRb-S57C-opt]-F-P2A-CD8SP2-CD16A-V158-ECD-v2-Myc-[preTCRa-Del48]-F-F2A-PAC |
| CD30 | 080316-D04 | 1134 | 3369 CD8SP-MYC-[hTCRa-T48C-opt1]-F-F2A-CD8SP-CD30-5F1-V5-[hTCRb-T57C-opt1]-F-P2A-Pac |
| Lym2 | 080316-K07 | 1135 | 3370 CD8SP-MYC-[hTCRa-T48C-opt1]-F-F2A-CD8SP-Lym2-V5-[hTCRb-T57C-opt1]-F-P2A-Pac |
| L1CAM | 080316-T02 | 1136 | 3371 CD8SP-MYC-[hTCRa-T48C-opt1]-F-F2A-CD8SP-L1CAM-9-3-Hu3-V5-[hTCRb-T57C-opt1]-F-P2A-Pac |
| GAD | 021716-H06 | 1137 | 3372 CD8SP-V5-[hTCRb-KACIAH]-F-P2A-SP-GAD-G3H8-MYC-[hTCRa-CSDVP]-F-F2A-Pac |
| MPL | 063016-E01 | 1138 | 3373 CD8SP-CD19-BU12-V5-[TCRb-opt]-F-P2A-SP-161HL-MYC-[TCRa-opt]-F-F2A-Pac |
| CD138 | 021916-R04 | 1139 | 3374 CD8SP-CD138-vL-V5-[hTCRb-WT]-F-P2A-SP-CD138-vH-Myc-[hTCRa-WT]-F-F2A-PAC |
| CD123 | 021916-S06 | 1140 | 3375 CD8SP-CD123-CSL-vL-V5-[hTCRb-WT]-F-P2A-SP-CD123-CSL-vH-Myc-[hTCRa-WT]-F-F2A-PAC |
| CS1 | 060616-K04 | 1141 | 3376 CD8SP-huLuc63vL-V5-huTCRβ-KACIAH-F-P2A-SP-HuLuc64vH-Mlu-MYC-huTCRα-CSDVP-F-F2A-Pac |
| CXCR4 and CD4 | 111915-U05 | 1142 | 3377 CD8SP-CXCR4-1-vHH-V5-[hTCRb-S57C-opt]-F-P2A-SP-CD4-8-03F1-vHH-Myc-[hTCRa-T48C-opt]-F-F2A-PAC |
| CD123 and CXCR4 | | 1143 | 3378 CD8SP-V5-[hTCRb-KACIAH]-F-P2A-SP-CD123-1-vHH-Myc-[hTCRa-CSDVP]-F-F2A-SP-CXCR4-1-vHH-LAILR-TM-CP |
| Dsg3 autoantibody | | 1144 | 3379 CD8SP-MYC-[hTCRa-T48C-opt1]-F-F2A-SP-Dsg3-ECD-V5-[hTCRb-S57C-opt1]-F-P2A-PAC |
| WT1 | 062416-H05 | 1145 | 3380 CD8SP-MYC3-WT1-Ab13-vL-Gly-Ser-Linker-WT1-Ab13-vH-Myc-[hTCRa-CSDVP]-F-F2A-PAC |
| Dsg3 autoantibody | | 1146 | 3381 CD8SP-V5-[hTCRb-KACIAH]-F-P2A-CD8SP-Dsg3-ECD-Myc-[preTCRa-Del48]-F-F2A-PAC |
| WT1 | 062716-Q02 | 1156 | 3391 CD8SP-MYC3-WT1-Ab15-scFv-Myc-[hTCRa-CSDVP]-F-F2A-PAC |
| CD19 | 111815-O05 | 1161 | 3396 CD8SP-4C3-vL-V5-[TCRb-S57C-opt1]-F-P2A-SP-4C3-vH-Myc-[TCRa-T48C-opt1]-F-F2A-PAC |
| TnMuc1 | 80916-D03 | 1164 | 3399 CD8SP-TnMuc1-hu5E5-RHA8-RKA-2-vL-V5-[hTCRb-KACIAH]-F-P2A-SP-TnMuc1-hu5E5-RHA8-RKA-2vH-Myc-[hTCRa-T48C-opt]-F-F2A-PAC |
| Lym1 | 041416-M03 | 1165 | 3400 CD8SP-Lym1-vL-V5-[TCRb-S57C-opt]-F-P2A-SP-Lym1-vH-MYC-[preTCRα-Del48]-F-F2A-Pac |
| IL6Ra and CD19 | 010416-L04 | 1166 | 3401 CD8SP-IL6R-304-vHH-V5-[hTCRb-KACIAH]-F-P2A-SP-FMC63-scFv-MYC-[hTCRa-CSDVP]-F-F2A-PAC |
| CD19 | 082815-I01 | 1167 | 3402 CD8SP-[hTCRb-KACIAH]-F-P2A-CD19MM-scFv-Myc-[hTCRa-WT]-F-F2A-PAC |
| CD19 | 041316-H02 | 1168 | 3403 CD8SP-FMC63-vL-V5-[hTCR-Gamma1]-F-P2A-CD8SP2-CD19MM-scFv-MYC-[hTCRa-CSDVP]-F-F2A-Pac |
| CD138 | 030316-G03 | 1169 | 3404 CD8SP-CD138-vL-Gly-Ser-Linker-CD138-vH-Myc-[hTCRa-CSDVP]-F-F2A-PAC |
| CXCR4 and CD123 | 111815-E04 | 1170 | 3405 CD8SP-CXCR4-1-vHH-V5-[hTCRb-S57C-opt]-F-P2A-SP-CD123-2-vHH-Myc-[hTCRa-T48C-opt]-F-F2A-PAC |
| CXCR4 and CD19 | 101415-V01 | 1171 | 3406 CD8SP-CXCR4-1-vHH-V5-[hTCRb-KACIAH]-F-P2A-SP-FMC63-vH-MYC-[hTCRa-CSDV]-F-F2A-Pac |

TABLE 7H-continued

SIRs Of Different Types Targeting Different Antigens

| | | | | |
|---|---|---|---|---|
| EGFR | 012216-Z07 | 1172 | 3407 | CD8SP-EGFR1-vHH-V5-[hTCRb-S57C-opt]-F-P2A-IgHSP-MYC-[hTCRa-T48C-opt]-F-F2A-Pac |
| EGFR and CEA | 040716-I05 | 1173 | 3408 | CD8SP-EGFR1-vHH-Gly-Ser-Linker-CEA1-vHH-Myc-[hTCRa-CSDVP]-F-F2A-PAC |
| EGFR and CD123 | 102915-J02 | 1174 | 3409 | CD8SP-EGFR1-vHH-V5-[hTCRb-S57C-opt]-F-P2A-SP-CD123-2-vHH-MYC-[hTCRa-T48C-opt]-F-F2A-Pac |
| EGFR and CEA | 102915-B02 | 1175 | 3410 | CD8SP-EGFR33-vHH-V5-[hTCRb-S57C-opt]-F-P2A-SP-CEA1-vHH-MYC-[hTCRa-T48C-opt]-F-F2A-Pac |
| EGFR and Her2 | 102915-K03 | 1176 | 3411 | CD8SP-EGFR1-vHH-V5-[hTCRb-S57C-opt]-F-P2A-SP-Her2-47D5-vHH-MYC-[hTCRa-T48C-opt]-F-F2A-Pac |
| EGFR and Her2 | 102915-F01 | 1177 | 3412 | CD8SP-EGFR1-vHH-V5-[hTCRb-S57C-opt]-F-P2A-SP-Her2-affi-MYC-[hTCRa-T48C-opt]-F-F2A-Pac |
| EGFR and Her2 | 102915-L03 | 1178 | 3413 | CD8SP-EGFR33-vHH-V5-[hTCRb-S57C-opt]-F-P2A-SP-Her2-47D5-vHH-MYC-[hTCRa-T48C-opt]-F-F2A-Pac |
| EGFR and Mesothelin | 102915-G07 | 1179 | 3414 | CD8SP-EGFR1-vHH-V5-[hTCRb-S57C-opt]-F-P2A-SP-SD1-vHH-MYC-[hTCRa-T48C-opt]-F-F2A-Pac |
| Her2 | 040716-K06 | 1180 | 3415 | CD8SP-Her2-5F7-vHH-Gly-Ser-Linker-Her2-47D5-vHH-Myc-[hTCRa-CSDVP]-F-F2A-PAC |
| Her3 and Her2 | 111815-B05 | 1181 | 3416 | CD8SP-Her3-affi-V5-[hTRCb-S57C-opt]-F-P2A-SP-Her2-affi-MYC-[hTCRa-T48C-opt]-F-F2A-PAC |
| Her3 and Her2 | 040716-H06 | 1182 | 3417 | CD8SP-Her3-17B05So-vHH-Gly-Ser-Linker-Her2-2D3-vHH-Myc-[hTCRa-CSDVP]-F-F2A-PAC |
| CD79b | 030316-N06 | 1183 | 3418 | CD8SP-huMA79bv28-vL-Gly-Ser-Linker-HuMA79bv28-vH-Myc-[hTCRa-CSDVP]-F-F2A-PAC |
| Mesothelin | 041816-H02 | 1184 | 3419 | CD8SP-Mesothelin-m912-vL-V5-[hTCRb-S57C-opt]-F-P2A-SP-m912-vH-Myc-[preTCRa-Del48]-F-F2A-PAC |
| Lym1 | 012716-B01 | 1185 | 3420 | CD8SP-Lym1-vL-[hTCRb-opt2]-F-P2A-SP-Lym1-vH-[hTCRa-opt2-Del]-F-F2A-PAC |
| Ig Fc | 020416-A08 | 1186 | 3421 | CD8SP-V5-[hTCRb-KACIAH]-F-P2A-CD8SP2-CD16A-v158-v2-Myc-[hTCRa-T48C-opt]-F-F2A-PAC |
| MPL | 040915-X03 | 1192 | 3427 | CD8SP-MPL-161-vL-scFv-Myc-[TCRa-T48C-opt1]-F-T2A-PAC |
| MPL | 032415-E07 | 1193 | 3428 | CD8SP-MPL-161-scFv-V5-[TCRb-S57C-opt1]-T2A-PAC |
| CD19 | 030515-A03 | 1194 | 3429 | CD8SP-FMC63-vL-scFv-Myc-[TCRa-T48C-opt1]-F-T2A-PAC |
| CD19 | 040915-Y05 | 1195 | 3430 | CD8SP-FMC63-scFv-V5-[TCRb-S57C-opt1]-T2A-PAC |
| CD19 | | 1196 | 3431 | pSBbi-puro-CD8SP-FMC63-vL-V5-[hTCRb-T48C-opt]-F-P2A-SP-FMC63-vH-MYC-[hTCRa-S57C-opt]-F-F2A |
| CD19 | | 1197 | 3432 | pSBbi-puro-CD8SP-FMC63-vL-V5-[hTCRb-KACIAH]-F-P2A-SP-FMC63-vH-MYC-[TCRa-CSDVP]-F-F2A |
| CD22 | | 1198 | 3433 | pSBbi-GP-CD8SP-CD22-m271-vL-V5-[hTCRb-KACIAH]-F-P2A-SP-CD22-m271-vH-MYC-[hTCRa-CSDVP]-F-F2A |
| CD123 | | 1199 | 3434 | pSBbi-GP-CD8SP-CD123-CSL362-vL-V5-[hTRCb-KACIAH]-F-P2A-SP-CD123-CSL362-vH-MYC-[hTCRa-CSDVP]-F-F2A |

| TARGET | CLONE ID | SEQ ID-(DNA) | SEQ ID-(PRT) | NAME |
|---|---|---|---|---|
| CD19 | 101216-H03 | 10474 | 12431 | CD8SP-FMC63-11-vL-V5-[TCRb-KACIAH]-F-P2A-FMC63vL-Myc-[TCRa-CSDVP]-F-F2A-PAC |
| CD19 | 022217-F01 | 10475 | 12432 | CD8SP-FMC63-vL-[hTCRa-CSDVP]-F-F2A-SP-FMC63-vH-[hTCRb-KACIAH]-F-P2A-PAC |
| CD19 | 040617-A09 | 10476 | 12433 | CD8SP-FMC63-vL-PG4SP-v2-[hTCRb-KACIAH]-F-P2A-SP-FMC63-vH-PG4SP-[hTCRa-CSDVP]-F-F2A-PAC |

TABLE 7H-continued

SIRs Of Different Types Targeting Different Antigens

| | | | | |
|---|---|---|---|---|
| CD19 | 040617-B09 | 10477 | 12434 | CD8SP-FMC63-vL-E-Coil-[hTCRb-KACIAH]-F-P2A-SP-FMC63-vH-K-coil-[hTCRa-CSDVP]-F-F2A-PAC |
| CD19 | 040617-C09 | 10478 | 12435 | CD8SP-FMC63-vL-EAAAK-[hTCRb-KACIAH]-F-P2A-SP-FMC63-vH-EAAAK-v2-[hTCRa-CSDVP]-F-F2A-PAC |
| CD19 | 110916-M04 | 10479 | 12436 | CD8SP-FMC63-vL-V5-[hTCRb-KACIAH]-F-P2A-SP-FMC63-vH-[GSG-hTCRa-T48C-opt]-F-F2A-PAC |
| CD19 | 110916-N08 | 10480 | 12437 | CD8SP-FMC63-vL-V5-[hTCRb-KACIAH]-F-P2A-SP-FMC63-vH-[hTCRa-T48C-opt]-F-F2A-PAC |
| CD19 | 110916-P02 | 10481 | 12438 | CD8SP-FMC63-vL-[hTCRb-S57C-opt]-F-P2A-SP-FMC63-vH-Myc-[hTCRa-CSDVP]-F-F2A-PAC |
| CD19 | 112116-R08 | 10482 | 12439 | CD8SP-FMC63-vL-[hTCRb-R18A22]-F-P2A-SP-FMC63-vH-Myc4-[hTCRa-SD]-F-F2A-PAC |
| CD19 | 112116-S08 | 10483 | 12440 | CD8SP-FMC63-vL-Myc2-[hTCRb-R18A22]-F-P2A-SP-FMC63-vH-Myc4-[hTCRa-SD]-F-F2A-PAC |
| CD19 | 112116-T08 | 10484 | 12441 | CD8SP-FMC63-vL-StreptagII-[hTCRb-R18A22]-F-P2A-SP-FMC63-vH-Myc4-[hTCRa-SD]-F-F2A-PAC |
| CD19 | 112116-U08 | 10485 | 12442 | CD8SP-FMC63-vL-[hTCRb-R18]-F-P2A-SP-FMC63-vH-Myc4-[hTCRa-SD]-F-F2A-PAC |
| CD19 | 112116-W08 | 10486 | 12443 | CD8SP-FMC63-vL-StreptagII-[hTCRb-R18]-F-P2A-SP-FMC63-vH-Myc4-[hTCRa-SD]-F-F2A-PAC |
| CD19 | 120916-R01 | 10487 | 12444 | CD8SP-FMC63-vL-V5-[hTCRb-KACIAH]-F-P2A-SP-FMC63-vH-Myc4-[hTCRα-SD]-F-F2A-PAC |
| CD19 | 121516-U07 | 10488 | 12445 | CD8SP-FMC63-vL-[hTCRb-RC]-F-P2A-SP-FMC63-vH-[hTCRa-CSDVP]-F-F2A-PAC |
| CD19 | 121516-V07 | 10489 | 12446 | CD8SP-FMC63-vL-hTCRb-RC-F-P2A-SP-FMC63-vH-[hTCRa-CSDVP]-F-F2A-PAC |
| CD19 | 121516-W05 | 10490 | 12447 | CD8SP-FMC63-vL-GSG-hTCRb-RAC-F-P2A-SP-FMC63-vH-Myc-[hTCRa-CSDVP]-F-F2A-PAC |
| CD19 | 121516-J07 | 10491 | 12448 | CD8SP-FMC63-vL-V5-[TCRb-S57C-opt1]-F-P2A-SP-GAtag-FMC63-vH-Myc-[TCRa-T48C-opt1]-F-F2A-PAC |
| CD19 | 110217-A03 | 10492 | 12449 | CD8SP-hu-FMC65-1-vL-[hTCRb-E15C]-F-P2A-SP-hu-FMC65-1-vH-[hTCRa-S15C] |
| CD19 | 110217-B04 | 10493 | 12450 | CD8SP-hu-FMC65-1-vL-[hTCRb-D59C]-F-P2A-SP-hu-FMC65-1-vH-[hTCRa-T45C] |
| CD19 | 110217-C03 | 10494 | 12451 | CD8SP-hu-FMC65-1-vL-[hTCRb-S77C]-F-P2A-SP-hu-FMC65-1-vH-[hTCRa-T45C] |
| CD19 | 110217-D01 | 10495 | 12452 | CD8SP-hu-FMC65-1-vL-[hTCRb-S17C]-F-P2A-SP-hu-FMC65-1-vH-[hTCRa-Y10C] |
| CD19 | | 10496 | 12453 | CD8SP-hu-FMC65-1-vL-[hTCRb-S17C]-F-P2A-SP-hu-FMC65-1-vH-[hTCRa-Y10C]-F-F2A-PAC |
| MPL and CD19 | 010417-U02 | 10497 | 12454 | CD8SP-V5-[hTCRb-KACIAH]-F-P2A-MPL-175-scFv-EAAAK-hCD19-Bu12-scFv-MYC-[hTCRa-CSDVP]-F-F2A-Pac |
| CS1 and CD19 | 010417-V07 | 10498 | 12455 | CD8SP-V5-[hTCRb-KACIAH]-F-P2A-HuLuc64-EAAAK-hCD19-Bu12-scFv-MYC-[hTCRa-CSDVP]-F-F2A-Pac |
| MPL and CD19 | 010417-W08 | 10499 | 12456 | CD8sp-V5-[hTCRb-KACIAH]-F-P2A-MPL-175-scFv-EAAAK-FMC64-scFv-MYC-[hTCRa-CSDVP]-F-F2A-Pac |
| CS1 and CD19 | 010417-X02 | 10500 | 12457 | CD8SP-V5-[hTCRb-KACIAH]-F-P2A-HuLuc64-EAAAK-FMC64-scFv-MYC-[hTCRa-CSDVP]-F-F2A-Pac |
| MPL and CD19 | 010417-Y05 | 10501 | 12458 | CD8sp-V5-[hTCRb-KACIAH]-F-P2A-MPL-175-scFv-EAAAK-huFMC63-11-scFv-MYC-[hTCRa-CSDVP]-F-F2A-Pac |
| CS1 and CD19 | 010417-Z03 | 10502 | 12459 | CD8SP-V5-[hTCRb-KACIAH]-F-P2A-HuLuc64-EAAAK-huFMC63-11-scFv-MYC-[hTCRa-CSDVP]-F-F2A-Pac |
| CD19 and CD33 | 010417-B04 | 10503 | 12460 | CD8sp-V5-[hTCRb-KACIAH]-F-P2A-hCD19-Bu12-EAAAK-CD33-AF5-scFv-MYC-[hTCRa-CSDVP]-F-F2A-Pac |
| CD19 and CS1 | 010417-C03 | 10504 | 12461 | CD8sp-V5-[hTCRb-KACIAH]-F-P2A-hCD19-Bu12-EAAAK-huLuc64-scFv-MYC-[hTCRa-CSDVP]-F-F2A-Pac |

TABLE 7H-continued

| | | | | SIRs Of Different Types Targeting Different Antigens |
|---|---|---|---|---|
| CD19 and MPL | 010417-E08 | 10505 | 12462 | CD8sp-V5-[hTCRb-KACIAH]-F-P2A-hCD19-BU12-EAAAK-MPL-175-MYC-[hTCRa-CSDVP]-F-F2A-Pac |
| CD19 and BCMA | 010417-F05 | 10506 | 12463 | CD8sp-V5-[hTCRb-KACIAH]-F-P2A-hCD19-Bu12-EAAAK-BCMA-ET-40-scFv-MYC-[hTCRa-CSDVP]-F-F2A-Pac |
| CD19 and CD20 | 010417-G08 | 10507 | 12464 | CD8sp-V5-[hTCRb-KACIAH]-F-P2A-hCD19-Bu12-EAAAK-CD20-2F2-scFv-MYC-[hTCRa-CSDVP]-F-F2A-Pac |
| CD19 and CD20 | 010417-H01 | 10508 | 12465 | CD8SP-V5-[hTCRb-KACIAH]-F-P2A-huFMC63-11-EAAAK-CD20-2F2-scFv-MYC-[hTCRa-CSDVP]-F-F2A-Pac |
| CD19 | 012417A01 | 10509 | 12466 | CD8SP-FMC63-vL-[hTCRb-KACIAH]-F-P2A-SP-FMC63-vH-Myc-[hTCRa-CSDVP]-F-F2A-PAC |
| CD19 | 012417-O06 | 10510 | 12467 | CD8SP-FMC63-vL-V5-[hTCRb-KACIAH]-F-P2A-SP-FMC63-vH-[preTCRa-Del48]-F-F2A-PAC |
| CD19 | 022217-E01 | 10511 | 12468 | CD8SP-FMC63-vL-[hTCRb-KACIAH]-F-P2A-SP-FMC63-vH-[hTCRa-CSDVP]-F-F2A-PAC |
| CD19 | 022217-F01 | 10512 | 12469 | CD8SP-FMC63-vL-[hTCRa-CSDVP]-F-F2A-SP-FMC63-vH-[hTCRb-KACIAH]-F-P2A-PAC |
| CD19 | 013117-K04 | 10513 | 12470 | CD8SP-FMC63-vL-V5-[hTCRb-KACIAH]-F-P2A-SP-FMC63-vH-[hTCRa-CSDVP]-ter-sal-DWPRE-K04 |
| CD19 | 020717-P08 | 10514 | 12471 | CD19-huSJ25C1-vL-V5-[hTCRb-KACIAH]-F-P2A-CD19-huSJ25C1-vH-IgG1-stalk2-MYC4-[hTCRa-CSDVP]-F-F2A-PAC |
| CD19 | 010417-F05 | 10515 | 12472 | CD8SP-CD19-Medi-3649-scFv-V5-[hTCRb-KACIAH]-F-P2A-MYC-[hTCRa-CSDVP]-F-F2A-Pac |
| CD19 and CD33 | 030217-E05 | 10516 | 12473 | CD8SP-hCD19-Bu12-scFv-V5-[hTCRb-KACIAH]-F-P2A-SP-CD33-huMy9-6-scFV-MYC-[hTCRa-CSDVP]-F-F2A-Pac |
| CD19 and Lym1 | 030217-J05 | 10517 | 12474 | CD8SP-hCD19-Bu12-scFv-V5-[hTCRb-KACIAH]-F-P2A-SP-Lym1-scFV-MYC-[hTCRa-CSDVP]-F-F2A-Pac |
| CD19 and Lym2 | 030217-K05 | 10518 | 12475 | CD8SP-hCD19-Bu12-scFv-V5-[hTCRb-KACIAH]-F-P2A-SP-Lym2-scFV-MYC-[hTCRa-CSDVP]-F-F2A-Pac |
| CD19 and CS1 | 030217-A05 | 10519 | 12476 | CD8SP-hCD19-Bu12-scFv-V5-[hTCRb-KACIAH]-F-P2A-SP-huLuc64-scFV-MYC-[hTCRa-CSDVP]-F-F2A-Pac |
| CD19 and CD20 | 030217-D02 | 10520 | 12477 | CD8SP-hCD19-Bu12-scFv-V5-[hTCRb-KACIAH]-F-P2A-SP-CD20-2F2-scFV-MYC-[hTCRa-CSDVP]-F-F2A-Pac |
| CD19 and CD38 | 030217-G04 | 10521 | 12478 | CD8SP-hCD19-Bu12-scFv-V5-[hTCRb-KACIAH]-F-P2A-SP-CD38-scFV-MYC-[hTCRa-CSDVP]-F-F2A-Pac |
| CD19 and CD33 | 030217-H02 | 10522 | 12479 | CD8SP-hCD19-Bu12-scFv-V5-[hTCRb-KACIAH]-F-P2A-SP-CD33-AF5-scFV-MYC-[hTCRa-CSDVP]-F-F2A-Pac |
| CD19 and CD123 | 030217-I05 | 10523 | 12480 | CD8SP-hCD19-Bu12-scFv-V5-[hTCRb-KACIAH]-F-P2A-SP-CD123-CSL-scFV-MYC-[hTCRa-CSDVP]-F-F2A-Pac |
| CD19 | 071417-G01 | 10524 | 12481 | CD8SP-FMC63-vL-Ecoil-HuFMC63-11-vL-[hTCRb-KACIAH]-F-P2A-SP-FMC63-vH-[hTCRa-CSDVP]-F-F2A-PAC |
| CD19 and CD20 | 071417-H01 | 10525 | 12482 | CD8SP-FMC63-vL-Ecoil-CD20-2F2-vL-[hTCRb-KACIAH]-F-P2A-SP-FMC63-vH-[hTCRa-CSDVP]-F-F2A-PAC |
| CD19 and CD22 | 071417-I05 | 10526 | 12483 | CD8SP-FMC63-vL-Ecoil-CD22-5-vL-[hTCRb-KACIAH]-F-P2A-SP-FMC63-vH-[hTCRa-CSDVP]-F-F2A-PAC |
| CD19 | 071417-J01 | 10527 | 12484 | CD8SP-FMC63-vL-Ecoil-MOR0028-vL-[hTCRb-KACIAH]-F-P2A-SP-FMC63-vH-[hTCRa-CSDVP]-F-F2A-PAC |
| CD19 and CD22 | 071417-N04 | 10528 | 12485 | CD8SP-Bu12-vL-Ecoil-CD22-5-vL-[hTCRb-KACIAH]-F-P2A-SP-FMC63-vH-[hTCRa-CSDVP]-F-F2A-PAC |
| CD19 | 071417-O08 | 10529 | 12486 | CD8SP-FMC63-vL-Ecoil-HuFMC63-11-vL-[hTCRa-CSDVP]-F-F2A-SP-FMC63-vH-[hTCRb-KACIAH]-F-P2A-PAC |
| CD19 | 071417-Q05 | 10530 | 12487 | CD8SP-FMC63-vL-Ecoil-CD22-5-vL-[hTCRa-CSDVP]-F-F2A-SP-FMC63-vH-[hTCRb-KACIAH]-F-P2A-PAC |

TABLE 7H-continued

| SIRs Of Different Types Targeting Different Antigens | | | | |
|---|---|---|---|---|
| CD19 and CD22 | 071417-S05 | 10531 | 12488 | CD8SP-HA22-vL-Ecoil-CD20-2F2-vL-[hTCRa-CSDVP]-F-F2A-SP-FMC63-vH-[hTCRb-KACIAH]-F-P2A-PAC |
| CD19 and CD22 | 071417-T06 | 10532 | 12489 | CD8SP-HA22-vL-Ecoil-CD22-5-vL-[hTCRa-CSDVP]-F-F2A-SP-FMC63-vH-[hTCRb-KACIAH]-F-P2A-PAC |
| CD22 | 080217-N07 | 10533 | 12490 | CD8SP-HA22-vL-Ecoil-CD20-2F2-vL-[hTCRa-CSDVP]-F-F2A-IgH-SP-HA22-vH-Kcoil-CD20-2F2-vH-[hTCRb-KACIAH]-F-P2A-PAC |
| CD19 | 080217-G04 | 10534 | 12491 | CD8SP-FMC63-vL-Ecoil-HuFMC63-11-vL-[hTCRb-KACIAH]-F-P2A-IgH-SP-FMC63-vH-Kcoil-HuFMC63-11-vH-[hTCRa-CSDVP]-F-F2A-PAC |
| CD19 and CD20 | 080217-H02 | 10535 | 12492 | CD8SP-FMC63-vL-Ecoil-CD20-2F2-vL-[hTCRb-KACIAH]-F-P2A-IgH-SP-FMC63-vH-Kcoil-CD20-2F2-vH-[hTCRa-CSDVP]-F-F2A-PAC |
| CD19 | 080217-M02 | 10536 | 12493 | CD8SP-FMC63-vL-Ecoil-MOR0028-vL-[hTCRa-CSDVP]-F-F2A-IgH-SP-FMC63-vH-Kcoil-MOR0028-vH-[hTCRb-KACIAH]-F-P2A-PAC |
| CD22 | 080217-O08 | 10537 | 12494 | CD8SP-HA22-vL-Ecoil-CD22-5-vL-[hTCRa-CSDVP]-F-F2A-IgH-SP-HA22-vH-Kcoil-CD22-5-vH-[hTCRb-KACIAH]-F-P2A-PAC |
| CD19 and CD22 | 080217-L08 | 10538 | 12495 | CD8SP-FMC63-vL-Ecoil-CD22-5-vL-[hTCRa-CSDVP]-F-F2A-IgH-SP-FMC63-vH-Kcoil-CD22-5-vH-[hTCRb-KACIAH]-F-P2A-PAC |
| CD19 | | 10539 | 12496 | CD8SP-EUK5-13-vL-IgCL-[hTCRb-KACIAH]-F-P2A-SP-EUK5-13-vH-IgG1-CH1-[hTCRa-CSDVP] |
| CD19 | | 10540 | 12497 | CD8SP-EUK5-13-vL-IgCL-[hTCRg]-F-P2A-SP-EUK5-13-vH-IgG1-CH1-[hTCRd] |
| CD19 | | 10541 | 12498 | CD8SP-EUK5-13-vL-IgCL-[hTCRb-KACIAH]-F-P2A-SP-EUK5-13-vH-IgG1-CH1-[pre-TCRa-Del48] |
| CD19 | | 10542 | 12499 | CD8SP-EUK5-13-vL-IgCL-[hTCRb-S57C-opt]-F-P2A-SP-EUK5-13-vH-IgG1-CH1-[hTCRa-T48C-opt] |
| CD19 | | 10543 | 12500 | CD8SP-[hTCRb-KACIAH]-F-P2A-CD8SP-EUK5-13-vL-Gly-Ser-Linker-EUK5-13-vH-IgG1-CH1-[hTCRa-CSDVP] |
| CD19 | | 10544 | 12501 | CD8SP-[hTCRb-KACIAH]-F-P2A-CD8SP-EUK5-13-vL-Gly-Ser-Linker-EUK5-13-vH-IgG1-CH1-[pre-TCRa-Del48] |
| CD19 | | 10545 | 12502 | CD8SP-hu-FMC65-1-vL-IgCL-[hTCRa-CSDVP]-F-F2A-SP-hu-FMC65-1-vH-IgG1-CH1-[hTCRb-KACIAH]-F-P2A-PAC |
| CD19 | | 10546 | 12503 | CD8SP-hu-FMC65-1-vL-IgCL-[hTCRb-KACIAH]-F-P2A-SP-hu-FMC65-1-vH-IgG1-CH1-[hTCRa-CSDVP] |
| CD19 | | 10547 | 12504 | CD8SP-hu-FMC65-1-vL-IgCL-[hTCRg]-F-P2A-SP-hu-FMC65-1-vH-IgG1-CH1-[hTCRd] |
| CD19 | | 10548 | 12505 | CD8SP-hu-FMC65-1-vL-IgCL-[hTCRb-KACIAH]-F-P2A-SP-hu-FMC65-1-vH-IgG1-CH1-[pre-TCRa-Del48] |
| CD19 | | 10549 | 12506 | CD8SP-hu-FMC65-1-vL-IgCL-[hTCRb-S57C-opt]-F-P2A-SP-hu-FMC65-1-vH-IgG1-CH1-[hTCRa-T48C-opt] |
| CD19 | | 10550 | 12507 | CD8SP-[hTCRb-KACIAH]-F-P2A-CD8SP-hu-FMC65-1-vL-Gly-Ser-Linker-hu-FMC65-1-vH-IgG1-CH1-[hTCRa-CSDVP] |
| CD19 | | 10551 | 12508 | CD8SP-[hTCRb-KACIAH]-F-P2A-CD8SP-hu-FMC65-1-vL-Gly-Ser-Linker-hu-FMC65-1-vH-IgG1-CH1-[pre-TCRa-Del48] |
| CD19 | 041117-M04 | 10552 | 12509 | CD8SP-FMC63-vL-TCRbECD-Bam-CD3zECDTMCP-opt-F-P2A-SP-FMC63-vH-hTCRa-CSDVP-ECDn-CD3zECDTMCP-opt2-F-F2A-PAC. M04 |
| CD19 | 041117-N06 | 10553 | 12510 | CD8SP-FMC63-vL-TCRbECD-Bam-CD3zECDTMCP-opt-F-P2A-SP-FMC63-vH-hTCRa-T48C-ECDn-CD3zECDTMCP-opt2-F-F2A-PAC. N06 |

TABLE 7H-continued

SIRs Of Different Types Targeting Different Antigens

| | | | | |
|---|---|---|---|---|
| CD19 | 042117-A05 | 10554 | 12511 | CD8SP-FMC63-vL-TCRb-KAC-ECD-Bam-CD3zECDTMCP-opt-F-P2A-SP-FMC63-vH-hTCRa-CSDVP-ECDn-CD3zECDTMCP-opt2-F-F2A-PAC.A05 |
| CD19 | 042117-B01 | 10555 | 12512 | CD8SP-FMC63-vL-TCRb-S57C-ECD-Bam-CD3zECDTMCP-opt-F-P2A-SP-FMC63-vH-hTCRa-T48C-ECDn-CD3zECDTMCP-opt2-F-F2A-PAC.B01 |
| CD19 | 042117-D01 | 10556 | 12513 | CD8SP-FMC63-vL-TCRbECD-Bam-CD3zECDTMCP-opt-F-P2A-SP-FMC63-vH-hTCRaECDn-CD3zECDTMCP-opt2-FF2A-PAC.D01 |
| CD19 | 042517-X04 | 10557 | 12514 | CD8SP-FMC63-vL-V5-TCRbECD-Bam-CD3zECDTMCP-opt-F-P2A-SP-FMC63-vH-Myc-hTCRaECDn-CD3zECDTM-28z-opt2-F-F2A-PAC |
| CD19 | 050417-F08 | 10558 | 12515 | CD8SP-FMC63-vL-TCRbECD-Bam-CD3zECDTM-BB-CD3e-CP-F-P2A-SP-FMC63-vH-Myc-hTCRaECDn-CD3zECDTMCP-opt2-F-F2A-PAC |
| CD19 | 050417-H08 | 10559 | 12516 | CD8SP-FMC63-vL-V5-TCRbECD-Bam-CD3zECDTMCP-opt-F-P2A-SP-FMC63-vH-Myc-hTCRaECDn-CD3zECDTM-BB-CD3e-CP-opt2-F2A-PAC |
| CD19 | 051217-O01 | 10560 | 12517 | CD8SP-FMC63-vL-TCRbECD-Bam-CD3zECDTM-BB-CD3e-CP-F-P2A-SP-FMC63-vH-Myc-hTCRaECDn-CD3zECDTM-BB-CD3e-CP-opt2-F2A-PAC |
| CD19 | 050517-C07 | 10561 | 12518 | CD8SP-FMC63-vL-TCRb-KAC-ECD-Bam-CD3zECDTM-BBz-opt-F-P2A-SP-FMC63-vH-hTCRa-CSDVP-ECDn-CD3zECDTMCP-opt2-F-F2A-PAC |
| CD19 | 050517-D07 | 10562 | 12519 | CD8SP-FMC63-vL-TCRb-S57C-ECD-Bam-CD3zECDTM-BBz-opt-F-P2A-SP-FMC63-vH-hTCRa-T48C-ECDn-CD3zECDTMCP-opt2-F-F2A-PAC.D07 |
| CD19 | 050517-E07 | 10563 | 12520 | CD8SP-FMC63-vL-TCRbECD-Bam-CD3zECDTM-BBz-opt-F-P2A-SP-FMC63-vH-hTCRaECDn-CD3zECDTMCP-opt2-FF2A-PAC |
| CD19 | 051217-S02 | 10564 | 12521 | CD8SP-FMC63-vL-hTCRaECDn-CD3zECDTMCP-opt2-F-F2A-SP-FMC63-vH-TCRbECD-Bam-CD3zECDTMCP-opt-F-P2A-PAC |
| CD19 | 053117-A01 | 10565 | 12522 | CD8SP-FMC63-vL-TCRbECD-Bam-CD3zECDTMCP-BBz-opt-F-P2A-SP-FMC63-vH-Myc4-hTCRaECDn-CD3zECDTMCP-BBz-opt2-F-F2A-PAC |
| CD19 | 053117-F01 | 10566 | 12523 | CD8SP-FMC63-vL-TCRbECD-Bam-CD3zECDTMCP-BBz-opt-F-P2A-SP-FMC63-vH-Myc-hTCRaECDn-CD3zECDTMCP-BBz-opt2-F-F2A-PAC |
| CD19 | 053117-G01 | 10567 | 12524 | CD8SP-FMC63-vL-TCRb-KAC-ECD-Bam-CD3zECDTM-BBz-opt-F-P2A-SP-FMC63-vH-hTCRa-CSDVP-ECDn-CD3zECDTMCP-BBz-opt2-F-F2A-PAC.G01 |
| CD19 | 053117-H06 | 10568 | 12525 | CD8SP-FMC63-vL-TCRb-S57C-ECD-Bam-CD3zECDTM-BBz-opt-F-P2A-SP-FMC63-vH-hTCRa-T48C-ECDn-CD3zECDTMCP-BBz-opt2-F-F2A-PAC |
| CD19 | 050917-K01 | 10569 | 12526 | CD8SP-FMC63-vL-V5-[hTCRbECD-Bam-CD3zECDTM-28z-opt]-F-P2A-SP-FMC63-vH-Myc-[hTCRaECDn-CD3zECDTM-28z-opt2] |
| CD19 | 062017-I03 | 10570 | 12527 | CD8SP-FMC63-vL-PG4SP-[hTCRaECD-CSDVPn-CD3zECDTMCP-opt2]-F-F2A-SP-FMC63-vH-PG4SP-v2-[hTCRbECD-KAC-Bam-CD3zECDTMCP-opt]-F-P2A-PAC |
| CD19 | 010717-A06 | 10571 | 12528 | CD8SP-FMC63-vL-V5-[hTCRbECD-Bam-CD3zECDTMCP-opt]-F-P2A-SP-FMC63-vH-Myc4-[hTCRaECD-CD3zECDTMCP-opt2]-F-F2A-PAC |
| CD19 | 010717-B06 | 10572 | 12529 | CD8SP-FMC63-vL-V5-[hTCRbECD-Bam-CD3zECDTMCP-opt]-F-P2A-SP-FMC63-vH-Myc-[hTCRaECDn-CD3zECDTMCP-opt2]-F-F2A-PAC |
| CD19 | 070517-G02 | 10573 | 12530 | CD8SP-pre-TCRa-Del48-F-F2A-CD8SP--CD19-hu-mRO05-1-scFv-V5-[hTCRb-S57C-opt]-F-P2A-Pac |

TABLE 7H-continued

| | | | SIRs Of Different Types Targeting Different Antigens |
|---|---|---|---|
| PTK7 | 071217-D03 | 10574 | 12531 | CD8SP-pre-TCRa-Del48-F-F2A-CD8SP--PTK7-12C6a-scFv-V5-[hTCRb-S57C-opt]-F-P2A-Pac |
| MPL | 071217-I06 | 10575 | 12532 | CD8SP-pre-TCRa-Del48-F-F2A-CD8SP-Hu161-2-scFv-V5-[hTCRb-S57C-opt]-F-P2A-Pac |
| CD38 and BCMA | 080817-B09 | 10576 | 12533 | CD8SP-CD38-717-vHH-PG4SP-v2-[hTCRb-KACIAH]-F-P2A-SP-BCMA-346-vHH-PG4SP-[hTCRa-CSDVP]-F-F2A-PAC |
| CD19 and CD20 | 080817-C09 | 10577 | 12534 | CD8SP-CD19-vHH-PG4SP-v2-[hTCRb-KACIAH]-F-P2A-SP-CD20-vHH-PG4SP-[hTCRa-CSDVP]-F-F2A-PAC |
| BCMA and CD38 | 080817-D09 | 10578 | 12535 | CD8SP-BCMA348vHH-PG4SP-v2-[hTCRb-KACIAH]-F-P2A-SP-CD38-331-vHH-PG4SP-[hTCRa-CSDVP]-F-F2A-PAC |
| BCMA | 072717-G01 | 10579 | 12536 | CD8sp-V5-[hTCRb-KACIAH]-F-P2A-R1-BCMA948-PG4SP-BCMA972-Ecoilx4-MYC-[hTCRa-CSDVP]-F-F2A-PAC |
| Chloride Channel | | 10580 | 12537 | CD8SP-V5-[hTCRb-KACIAH]-F-P2A-CD8SP-CLTX23-Myc-[hTCRa-CSDVP] |
| Chloride Channel | | 10581 | 12538 | CD8SP-MYC-[hTCRa-T48C-opt1]-F-F2A-SP-CLTX-V5-[hTCRb-S57C-opt1] |
| Chloride Channel | | 10582 | 12539 | CD8SP-CLTX-[hTCRa-CSDVP]-F-F2A-SP-CLTX23-[hTCRb-KACIAH]-F-P2A-PAC |
| PSMA | | 10583 | 12540 | CD8SP-V5-[hTCRb-KACIAH]-F-P2A-IgHSP-PSMA-centyrin-1-Myc-[hTCRa-CSDVP]-F-F2A-PAC |
| PSMA | | 10584 | 12541 | CD8SP-V5-[hTCRb-KACIAH]-F-P2A-IgHSP-PSMA-centyrin-1-Myc4-[preTCRa-Del48]-F-F2A-PAC |
| PSMA | | 10585 | 12542 | CD8SP-MYC-[hTCRa-T48C-opt1]-F-F2A-IgHSP-PSMA-centyrin-1-V5-[hTCRb-S57C-opt1]-F-P2A-PAC |
| PSMA | | 10586 | 12543 | CD8SP-V5-[hTCRg1-opt]-F-P2A-IgHSP-PSMA-centyrin-1-Myc-[hTCRd-opt]-F-F2A-PAC |
| PSMA | | 10587 | 12544 | CD8SP-V5-[hTCRb-KACIAH]-F-P2A-IgHSP-PSMA-centyrin-2-Myc-[hTCRa-CSDVP]-F-F2A-PAC |
| PSMA | | 10588 | 12545 | CD8SP-V5-[hTCRb-KACIAH]-F-P2A-IgHSP-PSMA-centyrin-2-Myc4-[preTCRa-Del48]-F-F2A-PAC |
| PSMA | | 10589 | 12546 | CD8SP-MYC-[hTCRa-T48C-opt1]-F-F2A-IgHSP-PSMA-centyrin-2-V5-[hTCRb-S57C-opt1]-F-P2A-PAC |
| PSMA | | 10590 | 12547 | CD8SP-V5-[hTCRg1-opt]-F-P2A-IgHSP-PSMA-centyrin-2-Myc-[hTCRd-opt]-F-F2A-PAC |
| PSMA | | 10591 | 12548 | CD8SP-V5-[hTCRb-KACIAH]-F-P2A-IgHSP-PSMA-centyrin-3-Myc-[hTCRa-CSDVP]-F-F2A-PAC |
| PSMA | | 10592 | 12549 | CD8SP-V5-[hTCRb-KACIAH]-F-P2A-IgHSP-PSMA-centyrin-3-Myc4-[preTCRa-Del48]-F-F2A-PAC |
| PSMA | | 10593 | 12550 | CD8SP-MYC-[hTCRa-T48C-opt1]-F-F2A-IgHSP-PSMA-centyrin-3-V5-[hTCRb-S57C-opt1]-F-P2A-PAC |
| PSMA | | 10594 | 12551 | CD8SP-V5-[hTCRgl-opt]-F-P2A-IgHSP-PSMA-centyrin-3-Myc-[hTCRd-opt]-F-F2A-PAC |
| EGFR and cMET | | 10595 | 12552 | CD8SP-EGFR-CENTRYN-V5-[hTCRb-KACIAH]-F-P2A-SP-cMET-CENTRYN-Myc-[hTCRa-CSDVP] |
| CD19 | | 18231 | 18239 | CD8SP-FMC63-vL-[hTCRa-S15C-SDVP]-F-F2A-SP-FMC63-vH-hTCRb-E15C-KAIAH] |
| CD19 | | 18232 | 18240 | CD8SP-FMC63-vL-[hTCRa-S15C-CSDVP]-F-F2A-SP-FMC63-vH-hTCRb-E15C-KACIAH] |
| IL1RAP | | 18242 | 18261 | CD8SP-hu-IL1RAP-CANO4-vL-[hTCRa-CSDVP]-F-F2A-SP-hu-IL1RAP-CANO4-vH-Mlu-[hTCRb-KACIAH]-F-P2A-Xba-PAC |
| IL1RAP | | 18243 | 18262 | CD8SP-hu-IL1RAP-CANO4-vL-PG4SP-v2-[hTCRb-KACIAH]-F-P2A-SP-hu-IL1RAP-CANO4-vH-PG4SP-[hTCRa-CSDVP]-F-F2A-PAC |
| IL1RAP | | 18244 | 18263 | CD8SP-V5-[hTCRb-KACIAH]-F-P2A-CD8SP-hu-IL1RAP-CANO4-scFv-Myc-[hTCRa-CSDVP]-F-F2A-PAC |

TABLE 7H-continued

SIRs Of Different Types Targeting Different Antigens

| | | | |
|---|---|---|---|
| IL1RAP | | 18245 | 18264 | CD8SP-hu-IL1RAP-CANO4-vL-[hTCRb-opt2]-F-P2A-SP-hu-IL1RAP-CANO4-vH-[hTCRa-opt2]-F-F2A-PAC |
| IL1RAP | | 18246 | 18265 | CD8SP-hu-IL1RAP-CANO4-vL-V5-[hTCRg1-opt]-F-P2A-SP-hu-IL1RAP-CANO4-vH-Myc-[hTCRd-opt]-F-F2A-PAC |
| IL1RAP | | 18247 | 18266 | CD8SP-hu-IL1RAP-CANO4-scFv-Myc-CD8TM-BBZ |
| IL1RAP | | 18248 | 18267 | CD8SP-IL1RAP-IAPB57-vL-[hTCRa-CSDVP]-F-F2A-SP-IL1RAP-IAPB57-vH-Mlu-[hTCRb-KACIAH]-F-P2A-PAC |
| IL1RAP | | 18249 | 18268 | CD8SP-IL1RAP-IAPB57-vL-PG4SP-v2-[hTCRb-KACIAH]-F-P2A-SP-IL1RAP-IAPB57-vH-PG4SP-[hTCRa-CSDVP]-F-F2A-PAC |
| IL1RAP | 112017-L02 | 18250 | 18269 | CD8SP-V5-[hTCRb-KACIAH]-F-P2A-CD8SP-IL1RAP-IAPB57-scFv-Myc-[hTCRa-CSDVP]-F-F2A-PAC |
| IL1RAP | | 18251 | 18270 | CD8SP-IL1RAP-IAPB57-vL-[hTCRb-opt2]-F-P2A-SP-IL1RAP-IAPB57-vH-[hTCRa-opt2]-F-F2A-PAC |
| IL1RAP | | 18252 | 18271 | CD8SP-IL1RAP-IAPB57-vL-V5-[hTCRgl-opt]-F-P2A-SP-IL1RAP-IAPB57-vH-Myc-[hTCRd-opt]-F-F2A-PAC |
| IL1RAP | | 18253 | 18272 | CD8SP-IL1RAP-IAPB57-scFv-Myc-CD8TM-BBz |
| IL1RAP | | 18254 | 18273 | CD8SP-IL1RAP-IAPB63-vL-[hTCRa-CSDVP]-F-F2A-SP-IL1RAP-IAPB63-vH-Mlu-[hTCRb-KACIAH]-F-P2A-PAC- |
| IL1RAP | | 18255 | 18274 | CD8SP-IL1RAP-IAPB63-vL-PG4SP-v2-[hTCRb-KACIAH]-F-P2A-SP-IL1RAP-IAPB63-vH-PG4SP-[hTCRa-CSDVP]-F-F2A-PAC |
| IL1RAP | 111517-E06 | 18256 | 18275 | CD8SP-V5-[hTCRb-KACIAH]-F-P2A-CD8SP-IL1RAP-IAPB63-scFv-Myc-[hTCRa-CSDVP]-F-F2A-PAC |
| IL1RAP | | 18257 | 18276 | CD8SP-IL1RAP-IAPB63-vL-[hTCRb-opt2]-F-P2A-SP-IL1RAP-IAPB63-vH-[hTCRa-opt2]-F-F2A-PAC |
| IL1RAP | | 18258 | 18277 | CD8SP-IL1RAP-IAPB63-vL-V5-[hTCRgl-opt]-F-P2A-SP-IL1RAP-IAPB63-vH-Myc-[hTCRd-opt]-F-F2A-PAC |
| IL1RAP | | 18259 | 18278 | CD8SP-IL1RAP-IAPB63-scFv-Myc-CD8TM-BBz |
| Ig Fc | | 18899 | 18900 | CD16-V158-v1-V5-[hTCRb-KACIAH]-F-P2A-MYC-[hTCRa-CSDVP]-F-F2A-Pac |
| BCMA | | 18900 | 18901 | CD8SP-V5-[hTCRb-KACIAH]-F-P2A-CD8SP-APRIL-CD8-Stalk-Myc-[hTCRa-CSDVP]-F-F2A-PAC |
| BCMA | | 18901 | 18902 | CD8SP-APRIL-CD8-stalk-V5-[hTCRb-KACIAH]-F-P2A-SP-Myc-[hTCRa-T48C-opt]-F-F2A-PAC |

TABLE 7I

LUC Fusion Constructs

| CLONE ID | SEQ ID DNA | SEQ ID PRT | NAME |
|---|---|---|---|
| 082214-Z01 | 10405 | 12362 | MPL-ECD-GGSG-Nluc-AcV5 |
| 062615-C04 | 10406 | 12363 | CD19-ECD-GGSG-NLuc-AcV5 |
| | 10407 | 12364 | CD19-ECD-GGSG-NLuc-4xFlag-2xStreptag-8xHis-T2A-Pac |
| 060816-A02 | 10408 | 12365 | CD33-ECD-GGSG-NLuc-4xFlag-2xStreptag-8xHis-T2A-Pac |
| 060816-C02 | 10409 | 12366 | CD138-ECD-GGSG-NLuc-4xFlag-2xStreptag-8xHis-T2A-Pac |
| 060816-D02 | 10410 | 12367 | Synth-CD123-ECD-GGSG-NLuc-4xFlag-2xStreptag-8xHis-T2A-Pac |
| 062816-G02 | 10411 | 12368 | CDH1-ECD-GGSG-NLuc-4xFlag-2xStreptag-8xHis-T2A-Pac |
| 082616-C07 | 10412 | 12369 | CD200R-ECD-GGSG-NLuc-4xFlag-2xStreptag-8xHis-T2A-Pac |
| 081716-R07 | 10413 | 12370 | GPNMB-ECD-GGSG-NLuc-4xFlag-2xStreptag-8xHis-T2A-Pac |
| 082216-S02 | 10414 | 12371 | PTK7-ECD-GGSG-NLuc-4xFlag-2xStreptag-8xHis-T2A-Pac |
| 062816-B06 | 10415 | 12372 | CD34-ECD-GGSG-NLuc-4xFlag-2xStreptag-8xHis-T2A-Pac |
| 060816-F08 | 10416 | 12373 | EpCAM-ECD-GGSG-NLuc-4xFlag-2xStreptag-8xHis-T2A-Pac |
| 060816-I04 | 10417 | 12374 | CD20-ECx2-ECD-GGSG-TurboLuc16-4xFlag-2xStreptag-8xHis-T2A-Pac |
| 060816-J14 | 10418 | 12375 | CD20-ECx1-ECD-GGSG-TurboLuc16-4xFlag-2xStreptag-8xHis-T2A-Pac |

TABLE 7I-continued

LUC Fusion Constructs

| CLONE ID | SEQ ID DNA | SEQ ID PRT | NAME |
| --- | --- | --- | --- |
| 082616-B03 | 10419 | 12376 | hCD22v5-ECD-GGSG-NLuc-4xFlag-2xStreptag-8xHis-T2A-Pac |
| 062816-C06 | 10420 | 12377 | TSHR-ECD-GGSG-NLuc-4xFlag-2xStreptag-8xHis-T2A-Pac |
| 060816-E01 | 10421 | 12378 | EGFRviii-ECD-GGSG-NLuc-4xFlag-2xStreptag-8xHis-T2A-Pac |
| 103116-Q07 | 10422 | 12379 | BCMA-ECD-GGSG-NLuc-4xFlag-2xStreptag-8xHis-T2A-Pac |
| 062816-A01 | 10423 | 12380 | CS1-ECD-GGSG-NLuc-4xFlag-2xStreptag-8xHis-T2A-Pac |
| 112316-Q02 | 10424 | 12381 | CD8SP-ProteinL-GGSG-NLuc-4xFLAG-x2STREP-8xHis-T2A-PAC |
| 101916-P03 | 10425 | 12382 | CD8SP-ProteinL-GGSG-NLuc-4xFLAG-x2STREP-8xHis-T2A-PAC |

In another aspect, the disclosure provides an isolated SIR polypeptide molecule comprising one or more antigen binding domains (e.g., antibody or antibody fragment, a ligand or a receptor) that bind to antigens as described herein, and are jointed to one or more T cell receptor constant chains.

In some embodiments, a SIR may comprise or consist of a single polypeptide that contains a single antigen binding domain joined to the NH-2-terminus of a single T cell receptor constant chain (Class 1). A construct encoding an exemplary Class 1 SIR is provided in Clone ID NO: 051216-F04. The nucleic acid sequence of the encoded SIR is presented in SEQ ID NO: 1023 and the amino acid sequence of the encoded SIR corresponds to SEQ ID NO: 3258.

In some embodiments, a SIR comprises or consists of two polypeptides that assemble to make a functional SIR (Class 2). Each of the polypeptides of such dual chain Class 2 SIR contains a T cell receptor constant chain and contains (as in Class 2A) or does not contain (as in Class 2B3) an antigen binding domain. In Class 2A SIRs, each of the antigen binding domains is joined to the N-terminus of a separate T cell receptor constant chain. For example, antigen binding domain 1 (e.g. vL fragment of an antibody) is joined to the constant chain of T cell receptor beta (TCRβ) to constitute functional polypeptide unit 1 and antigen binding domain 2 (vH fragment of an antibody) is joined to the constant chain of T cell receptor α (TCRα) to constitute functional polypeptide unit 2. The two functional polypeptide units of such SIR are coexpressed in the same cell and pair with each other to become functionally active. It should be noted that each of the antigen binding domains may in turn be bispecific or multispecific, thereby allowing the Class 2 SIRs to target more than 2 antigens. An exemplary Class 2A SIR which targets CD19 is provided in CD8SP-FMC63-vL-V5-[hTCRb-KACIAH]-F-P2A-SP-FMC63-vH-Myc-[hTCRa-CSDVP]-F-F2A-PAC (102615-C08) [SEQ ID NO:1200]. The nucleic acid sequence of this SIR is presented in SEQ ID NO: 1200 and its amino acid sequence corresponds to SEQ ID NO: 3435. In this SIR, the vL fragment derived from FMC63, a CD19 monoclonal antibody, is attached to constant region of a mutant (KACIAH) form of human TCRb chain via a linker while the vH fragment derived from the FMC63 monoclonal antibody is attached via a linker to the constant region of a mutant (CSDVP) human TCRα chain.

In some embodiments, a dual polypeptides chain SIR comprises or consists of an antigen binding domain that is joined to the NH2-terminus of only one T cell receptor constant chain (functional polypeptide unit 1) but is coexpressed with a second T cell receptor constant chain. Such SIRs are designated Class 2B. The purpose of the second T cell receptor constant chain in such Class 2B SIRs is to facilitate the cell surface expression of the functional polypeptide unit 1 (i.e. antigen binding domain 1 joined to a T cell receptor constant chain). As such, the second T cell receptor constant chain in Class 2B SIRs may be expressed by itself or expressed as a fusion protein carrying an epitope tag (e.g. MYC, V5, AcV5, G4S×2, StrepTagII etc) or expressed as a fusion protein carrying any irrelevant protein fragment (e.g. vL or vH fragment) so long as the irrelevant protein does not interfere with the assembly and function of the functional unit 1. As an example, a Class 2B SIR may comprise or consist of antigen binding domain 1 joined to the constant chain of T cell receptor alpha (TCRα) to constitute functional polypeptide unit 1 and the empty (i.e. lacking an antigen binding domain) constant chain of T cell receptor β (TCRβ) constituting the functional polypeptide unit 2. The two functional polypeptide units of such SIR are coexpressed in the same cell. A construct encoding an exemplary Class 2B SIR is provided in CD8SP-V5-[hTCRb-KACIAH]-F-P2A-CD8SP-FMC63-vL-Gly-Ser-Linker-FMC63-vH-Myc-[hTCRa-CSDVP]-F-F2A-PAC (082815-G07) [SEQ ID NO:1620]. The nucleic acid and amino acid sequences of the encoded SIR correspond to SEQ ID NO: 1620 and SEQ ID NO: 3855, respectively.

In some embodiments, the two functional polypeptide units of Class 2 SIRs are coexpressed in a cell using different vectors. In some embodiments, the two functional polypeptide units of the Class 2 SIRs are coexpressed in a cell using a single vector which employs two separate regulatory elements (e.g., promoters) to encode for two polynucleotides encoding the two functional polypeptide units of Class 2 SIRs. In some embodiments, the two functional polypeptide units of the Class 2 SIRs are coexpressed in a cell using a single vector which employs a single promoter to express a polynucleotide containing an IRES sequence that separates the nucleotide fragments encoding the two polypeptides of the SIR. In some embodiments, the two functional polypeptide units of the Class 2 SIRs are coexpressed in a cell using a single vector which employs a single promoter to express a polynucleotide encoding for a single polypeptide containing a cleavable linker (e.g. F2A, T2A, E2A, P2A, Furine-SGSG-F2A, Furine-SGSG-T2A, Furine-SGSG-E2A, Furine-SGSG-P2A etc.). The resulting mRNA encodes a single polypeptide which subsequently generates the two functional polypeptide units of the SIR. In some embodiments, the two functional polypeptide units of the Class 2 SIRs are coexpressed using transfection of a single mRNA sequence that encodes for both functional polypeptide units, while in other embodiments the two functional polypeptide units are coexpressed by transfection of two different mRNA sequences, each encoding for one functional polypeptide unit. In some embodiments, the vector or mRNA encoding the SIR may encode for additional genes/proteins (therapeutic controls, inhibitory molecules, accessory modules etc.), which may be separated from the SIR encoding sequences by IRES or cleavable linkers or combination thereof. In another embodiment, a therapeutic control or accessory module or both could be expressed in the cell in which SIR is expressed using a separate vector or mRNA. Exemplary therapeutic controls are provided in Table 8 (SEQ ID NOs: 3070 to 3076). It is to be understood that the therapeutic controls or accessory modules are not essential for the function of a SIR and any of the SIR of the embodiment can be used without the therapeutic control or the accessory modules. For example, the antibiotic resistance cassette, such as PAC (puromycin resistance gene), can be removed from the SIR-encoding vectors of this disclosure without compromising the functionality of the SIR.

Also provided are functional variants of the SIRs described herein, which have substantial or significant sequence identity or similarity to a parent SIR, which functional variant retains the biological activity of the SIR of which it is a variant. Functional variants encompass, for example, those variants of the SIR described herein (the parent SIR) that retain the ability to recognize target cells to a similar extent, the same extent, or to a higher extent, as the parent SIR. In reference to the parent SIR, the functional variant can, for instance, be at least about 30%, about 50%, about 75%, about 80%, about 85%, about 90%, about 91%, about 92%, about 93%, about 94%, about 95%, about 96%), about 97%, about 98%, about 99% or more identical in amino acid sequence to the parent SIR.

A functional variant can, for example, comprise the amino acid sequence of the parent SIR with at least one conservative amino acid substitution. Alternatively or additionally, the functional variants can comprise the amino acid sequence of the parent SIR with at least one non-conservative amino acid substitution. In this case, it is preferable for the non-conservative amino acid substitution to not interfere with or inhibit the biological activity of the functional variant. The non-conservative amino acid substitution may enhance the biological activity of the functional variant, such that the biological activity of the functional variant is increased as compared to the parent CAR.

The SIRs (including functional portions and functional variants) can be of any length, i.e., can comprise any number of amino acids, provided that the SIRs (or functional portions or functional variants thereof) retain their biological activity, e.g., the ability to specifically bind to antigen, detect diseased cells in a mammal, or treat or prevent disease in a mammal, etc. For example, the SIR can be about 300 to about 5000 amino acids long, such as 300, 400, 500, 600, 700, 800, 900, 1000 or more amino acids in length.

The SIRs (including functional portions and functional variants of the disclosure) can comprise synthetic amino acids in place of one or more naturally-occurring amino acids. Such synthetic amino acids are known in the art, and include, for example, aminocyclohexane carboxylic acid, norleucine, a-amino n-decanoic acid, homoserine, S-acetylaminomethyl-cysteine, trans-3- and trans-4-hydroxyproline, 4-aminophenylalanine, 4-nitrophenylalanine, 4-chlorophenylalanine, 4-carboxyphenylalanine, β-phenylserine β-hydroxyphenylalanine, phenylglycine, α-naphthylalanine, cyclohexylalanine, cyclohexylglycine, indoline-2-carboxylic acid, 1,2,3,4-tetrahydroisoquinoline-3-carboxylic acid, aminomalonic acid, aminomalonic acid monoamide, N'-benzyl-N'-methyl-lysine, N',N'-dibenzyl-lysine, 6-hydroxylysine, ornithine, α aminocyclopentane carboxylic acid, α-aminocyclohexane carboxylic acid, α-aminocycloheptane carboxylic acid, -(2-amino-2-norbornane)-carboxylic acid, γ-diaminobutyric acid, α, β-diaminopropionic acid, homophenylalanine, and α-tert-butylglycine.

The SIRs (including functional portions and functional variants) can be glycosylated, amidated, carboxylated, phosphorylated, esterified, N-acylated, cyclized via, e.g., a disulfide bridge, or converted into an acid addition salt and/or optionally dimerized or polymerized, or conjugated.

The disclosure provides a recombinant nucleic acid construct comprising a nucleic acid molecule encoding a SIR, wherein the nucleic acid molecule comprises a nucleic acid sequence encoding one or more antigen binding domains, wherein the nucleotide sequences encoding each of the antigen binding domains are contiguous with and in the same reading frame as the nucleic acid sequences encoding a T cell receptor constant chain. An exemplary T cell receptor constant chain that can be used in the construction of a SIR includes, but is not limited to, constant chain of TCRα. TCRβ1, TCRβ2, TCRγ, TCRδ, preTCRα and variants and mutants thereof (see, e.g., Tables 1-3). In some instances, the SIR can comprise a combination of constant chain of TCRa, TCRβ1, TCRβ2, TCRγ, TCRδ, preTCRα, and the like. The disclosure provides for SIRs comprising a pair of TCR constant chains selected from TCRα and TCRβ1, TCRα and TCRβ2, preTCRα and TCRβ1, preTCRα and TCRβ2, and TCRγ and TCRδ. The disclosure provides fusion of TCR constant chains with the CD3z chain that can substitute for TCR constant chains in the construction of SIRs. Furthermore, a human preTCRα constant chain in SIRs lacks the carboxy terminal 48 amino acids of the wild-type human preTCRα constant chain. The amino acid sequence of preTCRα lacking the carboxy terminal 48 amino acids is provided in SEQ ID NO: 3048.

The disclosure also provides a vector or vectors comprising a nucleic acid sequence or sequences encoding a SIR described herein. In one embodiment, the SIR is encoded by a single vector. In another embodiment, the SIR is encoded by more than one vector. In yet another embodiment, two functional polypeptide units of a SIR are each encoded by a separate vector or by separate nucleic acids. In one embodiment, the two functional polypeptide units of a SIR are encoded by a single vector or a single nucleic acid. In one embodiment, the vector or the vectors are chosen from DNA vector(s), RNA vector(s), plasmid(s), lentivirus vector(s), adenoviral vector(s), retrovirus vector(s), baculovirus vector(s), sleeping beauty transposon vector(s), or a piggyback transposon(s). In one embodiment, the vector is a lentivirus vector or a retroviral vector. In another embodiment, the vector is a sleeping beauty transposon vector. The nucleic acid sequences of several exemplary vectors are provided in SEQ ID NO: 870 to 876. The vectors pLenti-EF1α (SEQ ID NO: 870) and pLenti-EF1α-DWPRE (SEQ ID NO: 871) are empty lentiviral vectors that differ by the fact that pLenti-EF1α-DWPRE lacks the WPRE region. A SIR coding sequence of the disclosure can be cloned between the Nhe I and Sal I sites in these vectors. The vector MSCV-Bgl2-AvrII-Bam-EcoR1-Xho-BstB1-Mlu-Sal-ClaI.I03 (SEQ ID NO: 872) is a retroviral vector and a SIR coding sequence of the disclosure can be cloned between in the multicloning site of this vector. The vector MSCV-FMC63vL-V5-[TCRb-KACIAH]-F-P2A-2-Spe-FMC63vH-MYC-[TCRa-CSDVP]-F-F2A-Pac.N01 (SEQ ID NO: 873) is also a retroviral vector in which a SIR coding sequence is already present. A SIR coding sequence of the disclosure can be cloned in this vector by removing the existing SIR and inserting a nuclei acid encoding the new SIR. The vector pSBbi-Pur (SEQ ID NO: 874) is a sleeping beauty transposon vector. The vectors pSBbi-pur-EF1-FMC63vL-V5-[TCRb-KACIAH]-F-P2A-FMC63vH-MYC-[TCRa-CSDVP]-F-F2A-Xba.B01 (SEQ ID NO: 875) and pSBbi-pur-EF1-Nhe-FMC63vL-Xho-V5-[TCRb-S57C-opt]-F-P2A-Spe-FMC63vH-Mlu-MYC-[TCRa-T48C-opt]-F2A-MCS-I01 (SEQ ID NO: 876) are sleeping beauty transposon vectors containing SIR nucleic acids that can be used for subcloning the SIRs of the disclosure after removal of the existing SIR using standard recombinant DNA techniques known in the art.

The disclosure also includes an RNA construct that can be directly transfected into a cell. A method for generating mRNA for use in transfection involves in vitro transcription (IVT) of a template with specially designed primers, followed by poly A addition, to produce a construct containing 3' and 5' untranslated sequence ("UTR") (e.g., a 3' and/or 5' UTR described herein), a 5' cap (e.g., a 5' cap described herein) and/or Internal Ribosome Entry Site (IRES) (e.g., an IRES described herein), the nucleic acid to be expressed, and a poly A tail, typically 50-2000 bases in length (SEQ ID NO:860 and 861). RNA so produced can efficiently transfect different kinds of cells. In one embodiment, the template includes sequences for the SIR. In one embodiment, an RNA SIR vector is transduced into a cell, e.g., a T cell or a NK cell, by electroporation. In another embodiment, an RNA SIR vector is transduced into a cell, e.g., a T cell or a NK cell, by causing transient perturbations in cell membrane using a microfluid device. The different chains (or functional polypeptide units) of a SIR can be also introduced in a cell using one or more than one vector a combination of different vectors or techniques. As an example, the vectors CLONE ID NO: 050216-T02 and CLONE ID NO: 050216-S08 encode SEQ ID NO: 913 (CD8SP-FMC63-vL-V5-[hTCRb-KACIAH]-F-P2A-PAC) which comprises functional polypeptide unit 1 of a SIR in which the FMC63-vL chain is joined to hTCRb-KACIAH chain via a V5 linker. These vectors also express puromycin resistance gene (PAC). The vectors CLONE ID NO: 041916-A02 and 041916-B03 encode SEQ ID NO: 997 (CD8SP-FMC63-vH-MYC-[TCRa-CSDVP]-F-F2A-BlastR) which comprises functional polypeptide unit 2 of the SIR in which the FMC63-vH chain is joined to hTCRa-CSDVP chain via a MYC linker. These vectors also express blasticidin resistance gene (BlastR). The cells can be infected with lentiviruses encoding SEQ ID NO: 913 and SEQ ID NO: 997 either simultaneously or sequentially and then optionally selected for resistance to both puromycin and blasticidin to enrich for double-infected cells. The cells which are infected with both viruses will express both the functional polypeptide unit, which will then assemble to express the functional SIR on the cell surface. In another embodiment, one chain or functional polypeptide unit of SIR can be introduced using a retroviral vector while the other functional polypeptide unit is introduced using a lentiviral vector. In another aspect, one functional polypeptide unit is introduced using a lentiviral vector while the other functional polypeptide unit is introduced using a sleeping beauty transposon. In yet another aspect, one functional polypeptide unit is introduced using a lentiviral vector while the other functional polypeptide unit is introduced using RNA transfection. In yet another aspect, one functional polypeptide units is produced in a cell by genetic recombination at the endogeneous TCR chain loci using gene targeting techniques known in the art while the other functional polypeptide unit is introduced using a lentiviral or a retroviral vector.

RNA can be introduced into target cells using any of a number of different methods, for instance, commercially available methods which include, but are not limited to, electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendort, Hamburg Germany), cationic liposome mediated transfection using lipofection, polymer encapsulation, peptide mediated transfection, or biolistic particle delivery systems such as "gene guns" (see, for example, Nishikawa, et al. Hum Gene Ther., 12(8):861-70 (2001) or by causing transient perturbations in cell membranes using a microfluidic device (see, for example, patent applications WO 2013/059343 A1 and PCT/US2012/060646).

In some embodiments, the non-viral method includes the use of a transposon (also called a transposable element). In some embodiments, a transposon is a piece of DNA that can insert itself at a location in a genome, for example, a piece of DNA that is capable of self-replicating and inserting its copy into a genome, or a piece of DNA that can be spliced out of a longer nucleic acid and inserted into another place in a genome. For example, a transposon comprises a DNA sequence made up of inverted repeats flanking genes for transposition.

Exemplary methods of nucleic acid delivery using a transposon include a Sleeping Beauty transposon system (SBTS) and a piggyBac (PB) transposon system. See, e.g., Aronovich et al. Hum. Mol. Genet. 20.R1 (2011):R14-20; Singh et al. Cancer Res. 15 (2008):2961-2971; Huang et al. Mol. Ther. 16 (2008):580-589; Grabundzija et al. Mol. Ther. 18 (2010):1200-1209; Kebriaei et al. Blood. 122.21 (2013): 166; Williams. Molecular Therapy 16.9 (2008): 1515-16; Bell et al. Nat. Protoc. 2.12 (2007):3153-65; and Ding et al. Cell. 122.3 (2005):473-83, all of which are incorporated herein by reference.

The SBTS includes two components: 1) a transposon containing a transgene and 2) a source of transposase enzyme. The transposase can transpose the transposon from a carrier plasmid (or other donor DNA) to a target DNA, such as a host cell chromosome/genome. For example, the transposase binds to the carrier plasmid/donor DNA, cuts the transposon (including transgene(s)) out of the plasmid, and inserts it into the genome of the host cell. See, e.g., Aronovich et al. supra.

Exemplary transposons include a pT2-based transposon. See, e.g., Grabundzija et al. Nucleic Acids Res. 41.3 (2013): 1829-47; and Singh et al. Cancer Res. 68.8 (2008): 2961-2971, all of which are incorporated herein by reference. The nucleic acid sequences of exemplary transposons are provided in SEQ ID NO: 874 and SEQ ID NO: 875. Exemplary transposases include a Tc 1/mariner-type transposase, e.g., the SB 10 transposase or the SB 11 transposase (a hyperactive transposase which can be expressed, e.g., from a cytomegalovirus promoter). See, e.g., Aronovich et al.; Kebriaei et al.; and Grabundzija et al., all of which are incorporated herein by reference.

Use of the SBTS permits efficient integration and expression of a transgene, e.g., a nucleic acid encoding a SIR described herein. Provided herein are methods of generating a cell, e.g., T cell or NKT cell or stem cell or iPSC or synthetic T cell, that stably expresses a SIR described herein, e.g., using a transposon system such as SBTS.

In accordance with methods described herein, in some embodiments, one or more nucleic acids, e.g., plasmids, containing the SBTS components are delivered to a cell (e.g., T or NKT cell or stem cell or iPSC or synthetic T cell). For example, the nucleic acid(s) are delivered by standard methods of nucleic acid (e.g., plasmid DNA) delivery, e.g., methods described herein, e.g., electroporation, transfection, or lipofection. In some embodiments, the nucleic acid contains a transposon comprising a transgene, e.g., a nucleic acid encoding a SIR described herein. In some embodiments, the nucleic acid contains a transposon comprising a transgene (e.g., a nucleic acid encoding a SIR described herein) as well as a nucleic acid sequence encoding a transposase enzyme. In other embodiments, a system with two nucleic acids is provided, e.g., a dual-plasmid system, e.g., where a first plasmid contains a transposon comprising a transgene, and a second plasmid contains a nucleic acid sequence encoding a transposase enzyme. For example, the first and the second nucleic acids are codelivered into a host cell.

In some embodiments, cells, e.g., T or NKT or stem cells or iPSC or synthetic T cell, are generated that express a SIR described herein by using a combination of gene insertion using the SBTS and genetic editing using a nuclease (e.g., Zinc finger nucleases (ZFNs), Transcription Activator-Like Effector Nucleases (TALENs), the CRISPR/Cas system, or engineered meganuclease reengineered homing endonucleases).

In some embodiments, use of a non-viral method of delivery permits reprogramming of cells, e.g., T or NKT or stem cells or iPSC or synthetic T cell, and direct infusion of the cells into a subject. Advantages of non-viral vectors include but are not limited to the ease and relatively low cost of producing sufficient amounts required to meet a patient population, stability during storage, and lack of immunogenicity.

In some embodiments, the vector comprising a nucleic acid sequence encoding an SIR may further comprise a nucleic acid sequence encoding one or more inhibitory molecules. Non-limiting examples of inhibitory molecules contemplated herein include, for example, an inhKIR cytoplasmic domain; a transmembrane domain, e.g., a KIR transmembrane domain; and an inhibitor cytoplasmic domain, e.g., an ITIM domain, e.g., an inhKIR ITIM domain. In one embodiment, the inhibitory molecule is a wild-type inhKIR, or a sequence sharing at least 50, 60, 70, 80, 85, 90, 95 or 99% homology with, or that differs by no more than 1, 2, 3, 4, 5, 6, 7, 8, 9, 10, 15 or 20 residues from, a wild-type inhKIR; a SLAM family cytoplasmic domain; a transmembrane domain, e.g., a SLAM family transmembrane domain; and an inhibitor cytoplasmic domain, e.g., a SLAM family domain, e.g., an SLAM family ITIM domain. In another embodiment the inhibitory molecule is a wild-type SLAM family member, or a sequence sharing at least 50, 60, 70, 80, 85, 90, 95 or 99% homology with, or that differs by no more than 1, 2, 3, 4, 5, 6, 7, 8, 9, 10, 15 or 20 residues from, a wild-type SLAM family member.

In some embodiments, a vector of the disclosure can further comprise a promoter. Non-limiting examples of a promoter include, for example, an EF-1 promoter, a CMV IE gene promoter, an EF-1α promoter, an ubiquitin C promoter, a core-promoter or a phosphoglycerate kinase (PGK) promoter. In some embodiments, the promoter is an EF-1 promoter. In further embodiments, the EF-1 promoter comprises SEQ ID NO: 877. In some embodiments, the vector is an RNA nucleic acid. In some embodiments, the vector comprises a poly(A) tail. For example, contemplated herein is a poly(A) tail comprising about 150 adenosine bases (SEQ ID NO: 860 to SEQ ID NO: 864). In some embodiments, the vector comprises a 3'UTR.

In another aspect, the disclosure provides a method of making a cell (e.g., an immune effector cell or population thereof) comprising introducing into (e.g., transducing) a cell, e.g., a T cell, a NKT cell or a stem cell or a iPSC or a synthetic T cell described herein, with a vector comprising a nucleic acid encoding a SIR, e.g., a SIR described herein; or a nucleic acid encoding a SIR molecule e.g., a SIR described herein.

The cell can be an immune effector cell (e.g., a T cell or a NKT cell, or a combination thereof) or a stem/progenitor cell that can give rise to an immune effector cell or a synthetic T cell. In some embodiments, the cell in the methods is diaglycerol kinase (DGK) and/or Ikaros deficient. In some embodiments, the cell in the methods is deficient in constant chains of endogenous T cell receptor α, β1, β2, pre-TCRα, γ or δ or combination thereof. In some embodiments, the cell in the methods is deficient in HLA antigens. In some embodiments, the cell in the methods is deficient in 32 microglobulin. In some embodiments, the cell in the methods is deficient in expression of the target antigen of SIR. For example, the SIR expressing T cell is deficient in endogenous CD5 in case the SIR is directed against CD5 or is deficient in TCR-beta1 constant chain in case the SIR is directed against TCR-beta1 constant chain or is deficient in TCR-beta2 constant chain in case the SIR is directed against TCR-beta2 or is deficient in CS1 in case the SIR is directed against CS1.

In some embodiment, the introducing the nucleic acid molecule encoding a SIR comprises transducing a vector comprising the nucleic acid molecule encoding a SIR, or transfecting the nucleic acid molecule encoding a SIR, wherein the nucleic acid molecule is an in vitro transcribed RNA. In some embodiments, the nucleic acid molecule encodes two or more components of a SIR, are introduced by transducing a cell with more than one vector or transfecting with two or more nucleic acid molecules encoding the different subunits of a SIR. For example, a cell may be transduced with two separate vectors each encoding one of the two functional polypeptide units of a SIR. Exemplary SIR construct encoded by two separate vectors is provided by the SIR lentiviral construct 050216-S08 that contains the SIR sequence corresponding to SEQ ID NO: 913 encoding the SIR fragment CD8SP-FMC63-vL-V5-[hTCRb-KACIAH]-F-P2A-PAC in which the vL fragment derived from CD19 monoclonal antibody FMC63 is joined to the constant chain of hTCRb with KACIAH mutations via a V5 linker. This SIR FPU is connected via a F-P2A cleavable linker to PAC (puromycin resistance) gene. The vector for the 050216-S08 construct is pLenti-EF1α (SEQ ID NO: 870). The SIR lentiviral constructs 041916-A02 contains the SIR sequence corresponding to SEQ ID NO: 997 encoding the SIR fragment CD8SP-FMC63-vH-MYC-[TCRa-CSDVP]-F-F2A-BlastR in which the vH fragment derived from CD19 monoclonal antibody FMC63 is joined to the constant chain of hTCRa with CSDVP mutations via a MYC linker. This SIR FPU is connected via a F-F2A cleavable linker to a blasticidin resistance gene. The vector for the 041916-A02 construct is pLenti-EF1α-DWPRE (SEQ ID NO: 871). Exemplary selection markers are presented in SEQ ID NO: 795 to SEQ ID NO: 801. Similarly, a cell may be transduced with two separate in vitro transcribed RNAs each encoding one of the two functional polypeptide units of a SIR. In addition to the functional polypeptide units of the SIR, each of the RNAs may carry a different selection marker or reporter (e.g. tEGFR or CD34 or CNB30 or mutant DHFR) that can be used to select the cells transduced with both the RNAs and thus expressing both the functional polypeptide units of the SIR.

In some embodiments, the method further comprises: a) providing a population of immune effector cells (e.g., T cells or NK cells); and b) removing T regulatory cells from the population, thereby providing a population of T regulatory-depleted cells; wherein steps a) and b) are performed before introducing the nucleic acid encoding the SIR to the population. In embodiments of the methods, the T regulatory cells comprise $CD25^+$ T cells, and are removed from the cell population using a CD25 antibody, or fragment thereof. The CD25 antibody, or fragment thereof, can be attached to a substrate, e.g., a bead. In other embodiments, the population of immune effector cells that is depleted of T regulatory cells provided from step (b) contains less than 30%, 25%, 20%, 15%, 10%, 5%, 4%, 3%, 2%, 1% of CD25+ cells. In yet other embodiments, the method further comprises: removing cells from the population which express a disease-associated antigen that does not comprise CD25 to provide a population of T regulatory-depleted and disease-associated antigen depleted cells prior to introducing the nucleic acid encoding a SIR to the population. The disease-associated antigen can be selected from CD19, CD30, CD123, CD20, CD22, CD33, CD138, BCMA, Lym1, Lym2, CD79b, CD170, CD179b, CD14 or CD11b, or a combination thereof.

In other embodiments, the method further comprises depleting cells from the population which express a checkpoint inhibitor, to provide a population of T regulatory-depleted and inhibitory molecule depleted cells prior to introducing the nucleic acid encoding a SIR to the population. The checkpoint inhibitor can be chosen from CTLA-4, PD-1, LAG-3, TIM3, B7-H1, CD160, P1H, 2B4, CEACAM (e.g., CEACAM-1, CEACAM-3, and/or CEACAM-5), TIGIT, BTLA, and LAIR1.

The disclosure also provide recombinant cells, e.g., an immune effector cell, (e.g., a population of cells, e.g., a population of immune effector cells) and/or a stem cell (e.g., a hematopoietic stem cell, a peripheral blood stem cell, a bone marrow derived stem cell, an immune stem cell, an induced pluripotent stem cell or iPSC) comprising a nucleic acid molecule, a SIR polypeptide molecule, or a vector as described herein.

In some embodiments, the cell is an immune cell. Non-limiting examples of immune cells include T-cells and NK-cells. Further, non-limiting examples of T-cells include Tregs, CD8+ T cells, and CD4+ T cells. In one embodiment, the cell is a human T cell. In some embodiments, the cell is a human cell. In some embodiments, the cell is a dog cell.

In one embodiment, the human T cell is a T cell that expresses P-glycoprotein ((P-gp or Pgp; MDR1, ABCB1, CD243). In one embodiment, the human T cell is a T cell that stains dull with dyes that are substrates of P-glycoprotein mediated efflux. In one embodiment, the cell is a T cell as described in application no. PCT/US2017/042248, which is incorporated herein by reference. In some embodiments cells which lack expression of p-gp or p-gp activity are removed from the population.

In some embodiments, the cell is a T cell that is diaglycerol kinase (DGK) and/or Ikaros deficient.

In one embodiment, the cell is a T cell and the T cell is deficient in one or more of endogenous T cell receptor chains. T cells stably lacking expression of a functional TCR according to the disclosure may be produced using a, variety of approaches such as use of Zn finger nucleases (ZFN), CRISP/Cas9 and shRNA targeting the endogenous T cell receptor chains. A non-limiting exemplary method relating to shRNAs is described in US 2012/0321667A1, which is incorporated herein by reference. Another non-limiting exemplary method relating to eliminating endogenous TCR expression using ZFNs targeting constant regions of α and β chains of TCRs is described in Torikai H et al (Blood, 119(24), Jun. 14, 2012). It is to be noted that in some embodiments, the SIRs of the disclosure comprise constant chains of TCRs that are codon-optimized or are designed to differ in nucleotide sequences from the endogenous TCR constant chains and therefore escape targeting by the CRISP/Cas9, ZFN and/or shRNAs targeting the endogenous TCR constant chains.

A T cell lacking a functional endogenous TCR can be, e.g., engineered such that it does not express any functional endogenous TCR on its surface, engineered such that it does not express one or more subunits (e.g. constant chains of endogenous TCRa, TCRβ1, TCRβ2, TCRγ, TCRδ or pre-TCRα) that comprise a functional endogenous TCR or engineered such that it produces very little functional endogenous TCR on its surface. Alternatively, the T cell can express a substantially impaired endogenous TCR, e.g., by expression of mutated or truncated forms of one or more of the subunits of the TCR. The term "substantially impaired TCR" means that this TCR will not elicit an adverse immune reaction in a host. The unmodified TCRs are generally poorly expressed in primary human T cells when expressed ectopically (e.g. using retroviral or lentiviral vectors), suggesting that they compete inefficiently with endogenous TCR chains for cell surface expression. However, it was shown that optimization of the TCR chains for efficient translation in human cells results in better expression of the introduced TCR. More importantly, ectopic expression of such dominant TCR prevented surface expression of a large proportion of the endogenous TCR repertoire in human T cells.

In one embodiment, the cell is a stem cell and the stem cell is deficient in one or more of endogenous T cell receptor chains. In another embodiment, the cell is a stem cell in which one or more target antigens (e.g., MPL, CD33, CD123, CD19, etc.) of the SIR have been deleted or mutated to a form that is no longer recognized by the SIR. As an example, a SIR targeting CD19 is expressed in stem cells that have been made deficient in CD19 using CRISP/Cas9 or Zn finger nucleases so that the B cells produced by such stem cells are not eliminated by the T cells expressing the CD19-targeting SIR. Alternatively, a SIR targeting CD19 is expressed in stem cells in which the endogenous CD19 has been mutated to a form that is not targeted by SIR using CRISP/Cas9 or Zn finger nucleases so that the B cells produced by such stem cells are not eliminated by the T cells expressing the CD19-targeting SIR. In another embodiment, the SIR is expressed in immune effector cells and the stem cells from an autologous or an allogeneic donor are genetically engineered to either lack the expression of the SIR-target antigen or to express a mutated form of SIR target antigen which is not recognized by the SIR. For example, a SIR targeting CD19 is expressed in T cells that are infused into a patient along with autologous or allogeneic hematopoietic stem cells that have been made deficient in CD19 using CRISP/Cas9 or Zn finger nucleases so that the B cells produced by such stem cells are not eliminated by the T cells expressing the CD19-targeting SIR. Alternatively, a SIR targeting CD19 is expressed in T cells that are infused into a patient along with autologous or allogeneic hematopoietic stem cells in which the endogenous CD19 has been mutated to a form that is not targeted by SIR using CRISP/Cas9 or Zn finger nucleases so that the B cells produced by such stem cells are not eliminated by the T cells expressing the CD19-targeting SIR. A similar approach can be used to mutate or eliminate other endogenous antigens (e.g., MPL, CD33, CD123 etc.) in stem cells using shRNA, CRISP/Cas9 or Zn finger nucleases in subjects receiving SIR-T cells targeting these antigens for the treatment of specific diseases in which these antigens are expressed on disease associated or disease causing cells.

T cells or natural killer (NK) or stem cells, can be obtained from a subject. The term "subject" is intended to include living organisms in which an immune response can be elicited (e.g., mammals). Examples of subjects include humans, monkeys, chimpanzees, dogs, cats, mice, rats, and transgenic species thereof. T cells can be obtained from a number of sources, including peripheral blood mononuclear cells, bone marrow, lymph node tissue, cord blood, thymus tissue, tissue from a site of infection, ascites, pleural effusion, spleen tissue, and tumors. T cells could be tissue resident gamma-delta T cells, which can be cultured and expanded in vitro prior to expression of the SIR.

A SIR- and/or CAR- and/or Ab-TCR- and/or TRUC and/or cTCR-expressing immune effector cells can be expanded by stimulation with Protein L. In one aspect, Protein L is immobilized on beads or on another surface, such as a plate. In one aspect, Protein L is immobilized on the same beads as a CD3 antibody. In one aspect, Protein L is immobilized on the same beads as a CD28 antibody. In one aspect, Protein L is immobilized on beads to which both a CD3 antibody and a CD28 antibody are immobilized. In one aspect, Protein L is expressed on the surface of an artificial antigen presenting cell. In one aspect, Protein L is expressed on the surface of an artificial antigen presenting cell in conjunction with one or more co-stimulatory molecules. In one aspect, the co-stimulatory molecules include one or more of CD28, 41BB or OX40. In one aspect, the cell expressing Protein L on its surface is a mammalian cell. In one aspect, the cell is a human cell. In one aspect, the cell is 293FT cell. In other aspect, the cell is K562 cells. In one aspect, Protein L is expressed in the cell stably. In other aspect, Protein L is expressed in the cell transiently. Protein L can be expressed in the cells by any of the methods known in the art. In one aspect, the SIR or CAR or Ab-TCR, or TRUC or cTCR-expressing immune effector cells are expanded by co-culture with Protein L coated beads or a APC for a period of 10 min to several days or weeks (or any time-period there between).

In certain aspects of the disclosure, immune effector cells, e.g., T cells, can be obtained from a unit of blood collected from a subject using any number of techniques known to the skilled artisan, such as Ficoll™ separation. In one preferred aspect, cells from the circulating blood of an individual are obtained by apheresis. The apheresis product usually contains lymphocytes, including T cells, monocytes, granulocytes, B cells, other nucleated white blood cells, red blood cells, and platelets. In one aspect, the cells collected by apheresis may be washed to remove the plasma fraction and, optionally, to place the cells in an appropriate buffer or media for subsequent processing steps. In one embodiment, the cells are washed with phosphate buffered saline (PBS). In an alternative embodiment, the wash solution lacks calcium and may lack magnesium or may lack many if not all divalent cations.

Initial activation steps in the absence of calcium can lead to magnified activation. As those of ordinary skill in the art would readily appreciate a washing step may be accomplished by methods known to those in the art, such as by using a semi-automated "flow-through" centrifuge (for example, the Cobe 2991 cell processor, the Baxter CytoMate, or the Haemonetics Cell Saver 5) according to the manufacturer's instructions. After washing, the cells may be resuspended in a variety of biocompatible buffers, such as, for example, Ca-free, Mg-free PBS, PlasmaLyte A, or other saline solution with or without buffer. Alternatively, the undesirable components of the apheresis sample may be removed and the cells directly resuspended in culture media.

It is recognized that the methods of the application can utilize culture media conditions comprising 5% or less, for example 2%, human AB serum, and employ known culture media conditions and compositions, for example those described in Smith et al., "Ex vivo expansion of human T cells for adoptive immunotherapy using the novel Xeno-free CTS Immune Cell Serum Replacement" *Clinical & Translational Immunology* (2015) 4, e31; doi: 10.1038/cti.2014.31.

In one aspect, T cells are isolated from peripheral blood lymphocytes by lysing the red blood cells and depleting the monocytes, for example, by counterflow centrifugal elutriation or centrifugation through a PERCOLL™ gradient.

In another embodiment, a SIR-expressing effector cell described herein can further express an agent which enhances the activity of a SIR-expressing cell. In some embodiments, the agent is one that inhibits an inhibitory molecule. Non-limiting examples of inhibitory molecules include PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 and TGFR beta. Non-limiting examples of agents that inhibit these inhibitory molecules are provided in SEQ ID NO: 3102 to 3107 (coding sequence SEQ ID NO: 827-832)(see, Table 8). In one embodiment, the agent that inhibits an inhibitory molecule comprises a first polypeptide, e.g., a scFv or VHH or a receptor or a ligand fragment that binds an inhibitory molecule, associated with a second polypeptide that provides a positive signal to the cell, e.g., an intracellular signaling domain, such as 41BB, CD27, OX40, CD28, Dap10, CD2, CD5, ICAM-1, LFA-1, Lck, TNFR-1, TNFR-II, Fas, CD30, CD40 or combinations thereof) and/or a primary signaling domain (e.g., a CD3 zeta signaling domain). Exemplary SIRs expressing such polypeptides are presented in SEQ ID NO: 3217 to 3219 and SEQ ID NO: 3221 and 3222. In one embodiment, the agent that inhibits an inhibitory molecule comprises a first polypeptide, e.g., a scFv or VHH fragment or a receptor or a ligand fragment that binds an inhibitory molecule, associated with a T cell receptor constant chain described herein (e.g., constant chain of TCRa, TCRb1, TCRb2, pre-TCRa, pre-TCRa-Del48, TCR-gamma, or TCR-delta). Exemplary SIR that bind an inhibitory molecule are presented in SEQ ID NOs: 3572, 3573, 3574 and 3575.

In another embodiment, the SIR-expressing cell described herein can further express an accessory module, e.g., an agent which enhances the activity of a SIR-expressing cell. Several examples of accessory modules that comprise of agents that can enhance the activity of a SIR-expressing cell are provided in SEQ ID NO: 3087 to 3116 (Table 8). For example, in one embodiment, the agent can be an agent which increases the expression and/or activity of SIR chains (e.g., CD3ζ, CD3δ, CD3ε, CD3γ or combination thereof). In another embodiment, the agent can be an agent (e.g., vFLIP K13, vFLIP MC159, cFLIP-L, cFLIP-p22, HTLV1 Tax, HTLV2 Tax, 41BB or CD28) which provides costimulatory signal to SIR expressing cells. In another embodiment, the agent can be an agent (e.g., FKBPx2-K13, FKBPx2-MC159, FKBPx2-cFLIP, FKBPx2-cFLIP-L, FKBPx2-cFLIP-p22, FKBPx2-HTLV1 Tax, FKBPx2-HTLV2 Tax, FKBPx2-41BB or FKBPx2-CD28, Myr-MYD88-CD40-Fv'-Fv etc.) which provides costimulatory signal to SIR expressing cells in an inducible manner. In another embodiment, the agent can be a cytokine or a chemokine (e.g., CD40L, IL2, IL-7, IL-15, IL12f or IL-21) that promotes the proliferation or persistence of SIR-expressing cells. In another embodiment, the agent can be a soluble receptor (e.g., sHVEM or sHVEM-Alb8-vHH) that promotes the activity of SIR expressing cells and/or synergizes with SIR-expressing cells. In another embodiment, the agent can be an agent that inhibits an inhibitory molecule. Inhibitory molecules, e.g., PD1, can, in some embodiments, decrease the ability of a SIR-expressing cell to mount an immune effector response. In another embodiment, the agent can be a scFV targeting PD1 or CTLA4. Exemplary scFV targeting PD1 and CTLA4 are provided in SEQ ID NO: 3102 to 3107. In one embodiment, the agent comprises a first polypeptide, e.g., of an inhibitory molecule such as PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 or TGFR beta, or a fragment of any of these (e.g., at least a portion of an extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of an extracellular domain of PDl), and a second polypeptide of an intracellular signaling domain described herein (e.g., a CD28 signaling domain described herein and/or a CD3 zeta signaling domain described herein).

TABLE 8

| SEQ ID (DNA) | SEQ ID (PRT) | NAME |
|---|---|---|
| 795 | 3070 | PuroR Variant(PAC) |
| 796 | 3071 | BlastR |
| 797 | 3072 | CNB30 |
| 798 | 3073 | GMCSF-SP-tEGFR |
| 799 | 3074 | tEGFRviii |
| 800 | 3075 | tCD19 |
| 801 | 3076 | tBCMA |
| 802 | 3077 | hCD8-Hinge-TM |
| 803 | 3078 | hCD8-hinge-TM-BBz |
| 804 | 3079 | hCD8TM-hinge-BB |
| 805 | 3080 | 4-1BB-cytosolic-domain |
| 806 | 3081 | CD3z-cytosolic-domain |
| 807 | 3082 | CD3z-cytosolic-domain |
| 808 | 3083 | CD28-Hinge-TM-cytosolic-domain |
| 809 | 3084 | FKBP |
| 810 | 3085 | FKBP |
| 811 | 3086 | MYR |
| 812 | 3087 | Myr-MYD88-CD40-FV'-Fv |
| 813 | 3088 | IL12F |
| 814 | 3089 | 41BB-L |
| 815 | 3090 | CD40L |
| 816 | 3091 | K13 |
| 817 | 3092 | MC159 |
| 818 | 3093 | cFLIP-L/MRIT-alpha |
| 819 | 3094 | cFLIP-p22 |
| 820 | 3095 | FKBP-K13 |
| 821 | 3096 | FKBPX2-K13 |
| 822 | 3097 | HTLV1-TAX |
| 823 | 3098 | HTLV2-TAX |
| 824 | 3099 | HTLV2-TAX-RS |
| 825 | 3100 | icaspase-9 |
| 826 | 3101 | IGHSP2-IL6R-304-vHH-ALB8-VHH |
| 827 | 3102 | CD8SP2-PD1-4H1-scFv |
| 828 | 3103 | CD8SP2-PD1-5C4-scFv |
| 829 | 3104 | CD8SP2-CTLA4-Ipilimumab-scFv |
| 830 | 3105 | CD8SP2-PD1-4H1-Alb8-vHH |
| 831 | 3106 | CD8SP2-PD1-5C4-Alb8-vHH |
| 832 | 3107 | CD8SP2-CTLA4-Ipilimumab-Alb8-vHH |
| 833 | 3108 | IgSP-IL6-19A-scFV |
| 834 | 3109 | IgSP-Fx06 |
| 835 | 3110 | CD3z |
| 836 | 3111 | CD3-BBZ |
| 837 | 3112 | CD3z-GGGS-41BB |
| 838 | 3113 | LAILR1-TM-CP |
| 839 | 3114 | CD8SP2-SHVEM |
| 840 | 3115 | CD8SP2-sHVEM-Alb8-vHH |
| 841 | 3116 | hTERT |
| 842 | 3117 | Heparinase |

In one embodiment, the agent comprises a first polypeptide of PD-1 or a fragment thereof, and a second polypeptide of an intracellular signaling domain described herein (e.g., a CD28, CD27, OX40 or 4-IBB signaling domain and/or a CD3 zeta signaling domain). In another embodiment, the agent comprises a first polypeptide of PD-1 or a fragment thereof, and a second polypeptide which is a T cell receptor constant chain described herein (e.g., constant chain of TCRa, TCRb1, TCRb2, pre-TCRa, pre-TCRa-Del48, TCR-gamma, or TCR-delta).

In one embodiment, the SIR-expressing effector cell described herein can further comprise a second SIR that may include a different antigen binding domain to the same or a different target. In some embodiments, the second SIR may target the same or a different cell type from the first SIR.

In one embodiment, the SIR-expressing effector cell described herein can further comprise a CAR with the same or a different antigen binding domain, optionally the same or a different target. In some embodiments, the CAR may target the same or a different cell type from the first SIR. The nucleic acid and amino acid sequences of several exemplary CARs are presented in SEQ ID NO: 9659 to 9854 and SEQ ID NO: 9873 to 10068, respectively. In one embodiment, the CAR includes an antigen binding domain to a target expressed on the same disease cell type (e.g. cancer) as the disease associated antigen. In one embodiment, the SIR expressing cell comprises a SIR that targets a first antigen, and a CAR that targets a second, different, antigen and includes an intracellular signaling domain having no primary signaling domain but a costimulatory signaling domain. While not wishing to be bound by theory, placement of a costimulatory signaling domain, e.g., 4-1BB, CD28, CD27 or OX-40, onto CAR, can modulate the SIR activity to cells where both targets are expressed. In one embodiment, the SIR expressing cell comprises i) a first disease associated antigen SIR that includes one or more antigen binding domains that bind a target antigen described herein, and one or two TCR constant chains, and ii) a CAR that targets a different target antigen (e.g., an antigen expressed on that same disease associated (e.g. cancer) cell type as the first target antigen) and includes an antigen binding domain, a transmembrane domain and a primary signaling domain and a costimulatory domain. The nucleic acid and amino acid sequences of an exemplary construct with this configuration are presented in SEQ ID NO: 983 and SEQ ID NO: 3218, respectively. The antigen binding domains of the SIR in this construct are comprised of the vL and vH fragments derived from FMC63 monoclonal antibody that targets CD19, while the antigen binding domain of the CAR is comprised of the extracellular domain of PD1. The primary signaling domain of the CAR in this construct comprises of CD3z cytosolic domain while the costimulatory domain comprises of the 4-1BB cytosolic domain. In another embodiment, the SIR expressing cell comprises a i) SIR that includes an antigen binding domain that binds a target antigen described herein, and one or two TCR constant chains and ii) a CAR that targets an antigen other than the first target antigen (e.g., an antigen expressed on the same cancer cell type as the first target antigen) and includes an antigen binding domain to the antigen, a transmembrane domain and a costimulatory signaling domain. The nucleic acid and amino acid sequences of an exemplary construct with this configuration are presented in SEQ ID NO: 982 and SEQ ID NO: 3217, respectively. This construct is similar to the construct shown in SEQ ID NO: 983 with the exception that the CAR lacks the CD3z domain. In yet another embodiment, the SIR expressing cell comprises i) a first disease associated antigen SIR that includes one or more antigen binding domains that bind a target antigen described herein, and one or two TCR constant chains, and ii) a CAR that targets a different target antigen (e.g., an antigen expressed on that same disease associated (e.g. cancer) cell type as the first target antigen) and includes an antigen binding domain, a transmembrane domain and a primary signaling domain but without a costimulatory domain.

In one embodiment, the CAR comprises the antigen binding domain, a transmembrane domain and an intracellular signaling domain (such as but not limited to one or more intracellular signaling domain from 41BB, CD27, OX40, CD28, Dap10, CD2, CD5, ICAM-1, LFA-1, Lck, TNFR-1, TNFR-II, Fas, CD30, CD40 or combinations thereof) and/or a primary signaling domain (such as but not limited to a CD3 zeta signaling domain). Exemplary SIRs co-expressing a CAR are presented in SEQ ID NO: 3217 to 3219 and SEQ ID NO: 3221 and 3222.

In one embodiment, the SIR-expressing effector cell comprises a SIR described herein and an inhibitory CAR. In one embodiment, the inhibitory CAR comprises an antigen binding domain that binds an antigen found on normal cells but not cancer cells. In one embodiment, the inhibitory CAR comprises an antigen binding domain, a transmembrane domain and an intracellular domain of an inhibitory molecule. For example, the intracellular domain of the inhibitory CAR can be an intracellular domain of any one of PD1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 or TGFR beta. An exemplary SIR polypeptide co-expressing an inhibitory CAR is presented in SEQ ID NO: 3220. The inhibitory CAR in this polypeptide expresses a vHH targeting CXCR4 fused to the transmembrane domain and the cytosolic domain of LAIR1.

In certain embodiments, the antigen binding domain of the SIR molecule comprises a scFv and the antigen binding domain of the CAR molecule does not comprise a scFv. For example, the antigen binding domain of the SIR molecule comprises a scFv and the antigen binding domain of the CAR molecule comprises a camelid VHH domain.

In one embodiment, the disclosure provides an immune effector cell (e.g., T cell, NK cell) expressing a SIR comprising an antigen binding domain that binds to a tumor antigen as described herein, and a CAR comprising a PD 1 extracellular domain or a fragment thereof. In some embodiments, the cell further comprises an inhibitory molecule comprising an inhKIR cytoplasmic domain; a transmembrane domain, e.g., a KIR transmembrane domain; and an inhibitor cytoplasmic domain, e.g., an ITIM domain, e.g., an inhKIR ITIM domain. In one embodiment, the inhibitory molecule is a naturally occurring inhKIR, or a sequence sharing at least 50, 60, 70, 80, 85, 90, 95, or 99% homology with, or that differs by no more than 1, 2, 3, 4, 5, 6, 7, 8, 9, 10, 15, or 20 residues from, a naturally occurring inhKIR; or a SLAM family cytoplasmic domain; a transmembrane domain, e.g., a SLAM family transmembrane domain; and an inhibitor cytoplasmic domain, e.g., a SLAM family domain, e.g., an SLAM family ITIM domain. In another embodiment the inhibitory molecule is a naturally occurring SLAM family member, or a sequence sharing at least 50, 60, 70, 80, 85, 90, 95, or 99% homology with, or that differs by no more than 1, 2, 3, 4, 5, 6, 7, 8, 9, 10, 15, or 20 residues from, a naturally occurring SLAM family member.

The disclosure also provides a method comprising administering a SIR molecule, a cell expressing a SIR molecule or a cell comprising a nucleic acid encoding a SIR molecule to a subject. In one embodiment, the subject has a disorder described herein, e.g., the subject has cancer, infectious disease, allergic disease, degenerative disease or autoimmune disease, which expresses a target antigen described herein. In yet one embodiment, the subject has increased risk of a disorder described herein, e.g., the subject has increased risk of cancer, infectious disease, allergic disease, degenerative disease or autoimmune disease, which expresses a target antigen described herein. In one embodiment, the subject is a human. In another embodiment, the subject is an animal. In yet another embodiment, the subject is a companion animal such as a dog.

The disclosure provides methods for treating or preventing a disease associated with expression of a disease associated antigen described herein.

In one embodiment, the disclosure provides methods of treating or preventing a disease by providing to the subject in need thereof immune effector cells (e.g., T cells) or stem cells that can give rise to immune effector cells that are engineered to express an targeted X-SIR, wherein X represents a disease associated antigen as described herein, and wherein the disease causing or disease-associated cells express said X antigen. Table 9 provides a list of different antigens and the exemplary diseases that can be prevented, inhibited or treated using immune effector cells expressing SIRs targeting these antigens.

TABLE 9

| SIR "X" TARGET | EXEMPLARY DISEASE TARGETED BY SIR |
|---|---|
| CD19 | ALL, CLL, lymphoma, lymphoid blast crisis of CML, multiple myeloma, immune disorders |
| ALK | Non Small Cell Lung Cancer (NSCLC), ALCL (anaplastic large cell lymphoma), IMT (inflammatory myofibroblastic tumor), or neuroblastoma |
| CD45 | Blood cancers |
| BCMA | Myeloma, PEL, plasma cell leukemia, Waldenstrom's macroglobinemia |
| CD5 | Blood cancer, T cell leukemia, T cell lymphoma |
| CD20 | Blood cancers, Leukemia, ALL, CLL, lymphoma, immune disorders |
| CD22 | Blood cancers, Leukemia, ALL, CLL, lymphoma, lymphoid blast crisis of CML, immune disorders |
| CD23 | Blood cancers, Leukemia, ALL, CLL, lymphoma, autoimmune disorders |
| CD30 | Hodgkins's lymphoma, Cutaneous T cell lymphoma |
| CD32 | Solid tumors |
| CD33 | Blood cancers, AML, MDS |
| CD34 | Blood cancers, AML, MDS |
| CD44v6 | Blood cancers, AML, MDS |
| CD70 | Blood cancers, lymphoma, myeloma, Waldenstrom's macroglobulinemia |
| CD79b | Blood cancers, ALL, Lymphoma |
| CD123 | Blood cancers, AML, MDS |
| CD138 | Blood cancers, Myeloma, PEL, plasma cell leukemia, Waldenstrom's macroglobulinemia |
| CD179b | Blood cancers, ALL, Lymphoma |
| CD276/ B7-H3 | Ewing's sarcoma, neuroblastoma, rhabdomyosarcoma, ovarian, colorectal and lung cancers |
| CD324 | Solid tumors, esophageal, prostate, colorectal, breast, lung cancers |
| CDH6 | Solid tumors, renal, ovarian, thyroid cancers |
| CDH17 | Adenocarciniomas, gastrointestinal, lung, ovarian, endometrial cancers |
| CDH19 | Solid tumor, Melanoma |
| EGFR | Colon cancer, lung cancer |
| CLEC5A | Blood cancers, Leukemia, AML |
| GR/LHR | Prostate cancer, ovarian cancer or breast cancer |
| CLL1 | Blood cancer, Leukemia |
| CMVpp65 | CMV infection, CMV colitis, CMV pneumonitis |
| CS1 | Blood cancers, myeloma, PEL, plasma cell leukemia |
| CSF2RA | AML, CML, MDS |
| CD123 | Blood cancers, AML, MDS |
| DLL3 | Melanoma, lung cancer or ovarian cancer |
| EBNA3c/ MHC I | Epstein Barr virus infection and related diseases including cancers |

TABLE 9-continued

| SIR "X" TARGET | EXEMPLARY DISEASE TARGETED BY SIR |
|---|---|
| EBV-gp350 | Epstein Barr virus infection and related diseases |
| EGFR | Solid tumors, Colon cancer, lung cancer |
| EGFRvIII | Solid tumors, glioblastoma |
| EpCam1 | Gastrointestinal cancer |
| FLT3 | Blood cancers, AML, MDS, ALL |
| Folate Receptor alpha (FR1) | Ovarian cancer, NSCLC, endometrial cancer, renal cancer, or other solid tumors |
| FSHR | Prostate cancer, ovarian cancer or breast cancer |
| GD2 | Neuroblastoma |
| GD3 | Melanoma |
| GFRa4 | Cancer, thyroid medullary cancer |
| Fucosyl-GM1 (GM1) | Small cell lung cancer |
| GPRC5D | Myeloma, PEL, plasma cell leukemia, Waldenstrom's macroglobulinemia |
| Gp100 | Melanoma |
| GPC3 | Solid tumors, Lung cancer |
| gpNMB | Melanoma, brain tumors, gastric cancers |
| GRP78 | Myeloma |
| Her2 | Solid tumors, breast cancer, stomach cancer |
| Her3 | Colorectal, breast cancer |
| HMW-MAA | Melanoma |
| HTLV1-TAX/MHC I | HTLV1 infection associated diseases, Adult T cell leukemia-lymphoma |
| IL11Ra | Blood cancers, AML, ALL, CML, MDS, sarcomas |
| IL6Ra | Solid tumors, Liver cancer |
| IL13Ra2 | Glioblastomas |
| KSHV-K8.1 | Kaposi's sarcoma, PEL, Multicentric Castleman's disease |
| LAMP1 | Blood cancers, AML, ALL, MDS, CLL, CML |
| LewisY | Cancers |
| L1CAM | Solid tumors, ovarian, breast, endometrial cancers, melanoma |
| LHR | Prostate cancer, ovarian cancer or breast cancer |
| Lym1 | Blood cancer, Leukemia, Lymphoma |
| Lym2 | Blood cancer, Leukemia, Lymphoma |
| CD79b | Blood cancers, lymphoma |
| MART1/MHC I | Melanoma |
| Mesothelin | Mesothelioma, ovarian cancer, pancreatic cancer |
| Muc1/MHC I | Breast cancer, gastric cancer, colorectal cancer, lung cancer, or other solid tumors |
| Muc16 | Ovarian cancer |
| NKG2D | Leukemia, lymphoma or myeloma |
| NYBR1 | Breast cancer |
| PSCA | Prostate cancer |
| PR1/MHC I | Blood cancer, Leukemia |
| PSMA | Prostate cancer |
| PTK7 | Melanoma, lung cancer or ovarian cancer |
| ROR1 | Blood cancer, B cell malignancy, lymphoma, CLL |
| SLea | Pancreatic cancer, colon cancer |
| SSEA4 | Pancreatic cancer |
| Tyrosinase/MHC I | Melanoma |
| TCRB1 | T cell leukemias and lymphomas, autoimmune disorders |
| TCRB2 | T cell leukemias and lymphomas, autoimmune disorders |
| TCRgd | T cell leukemias and lymphomas, autoimmune disorders |
| hTERT | Solid tumors, blood cancers |
| TGFBR2 | Solid tumors, keloid |
| TIM1/HAVCR 1 | Kidney cancer, liver cancer |
| TROP2 | Solid tumors, Breast cancer, prostate cancer |
| TSHR | Thyroid cancer, T cell leukemia, T cell Lymphoma |
| TSLPR | Blood cancers, Leukemias, AML, MDS |
| Tyrosinase/MHC I | Melanoma |
| VEGFR3 | Solid tumors |
| WT1/MHC I | Blood cancers, AML |
| Folate Receptorβ | AML, Myeloma |
| B7H4 | Breast cancer or ovarian cancer |
| CD23 | Blood cancers, Leukemias, CLL |
| GCC | Gastrointestinal cancer |
| CD200R | Blood cancers, AML, MDS |
| AFP/MHC I | Solid tumors, Liver cancer |
| CD99 | Liver cancer |
| GPRC5D | Myeloma, Waldenstrom's macroglobinemia |
| HPV16-E7/MHC I | HPV16 associated cancers, cervical cancer, head and neck cancers |
| Tissue Factor 1 (TF1) | Solid tumors |
| Tn-Muc1 | Solid tumors and blood cancers |
| Igk-Light Chain | Myeloma, plasma cell leukemia |
| Ras G12V/MHC I | Solid tumors and blood cancers |
| CLD18A2 (Claudin 18.2) | Gastric, pancreatic, esophageal, ovarian, or lung cancer |
| CD43 | Blood cancers, AML |
| NY-ESO-1/MHC I | Myeloma |
| MPL/TPO-R | Blood cancer, AML, MDS, CML, ALL |
| P-glycoprotein (MDR1) | Renal cancer, liver cancer, Myeloma |
| CD179a | Blood cancers, Acute Leukemia, CLL, ALL, Lymphoma |
| STEAP1 | Gastric or prostate cancer, or lymphoma |
| Liv1 (SLC39A6) | Breast or prostate cancer |
| Nectin4 (PVRL4) | Bladder, renal, cervical, lung, head and neck or breast cancer |
| Cripto (TDGF1) | Colorectal or endometrial or ovarian cancer |
| gpA33 | Colorectal or endometrial or ovarian cancer |
| FLT3 | Blood cancers, AML, ALL, MDS |
| BST1/CD157 | Blood cancers, AML, MDS |
| IL1RAP | Liver, colorectal, cervical, lung or ovarian cancer |
| Chloride channel | Glioma |
| IgE | Allergy |
| HLA-A2 | Graft vs host disease, tissue rejection (SIR Expressed in regulatory T cells) |
| Amyloid | Amyloidoses, alzheimer's disease |
| HIV1-env | HIV/AIDS and related conditions |
| HIV1-gag | HIV/AIDS and related conditions |
| Influenza A HA | Influenza A infection |

In another embodiment, the disclosure provides methods of treating or preventing cancer by providing to the subject in need thereof immune effector cells (e.g., T cells) that are engineered to express a XSIR (or X-SIR) described herein, wherein the cancer cells express antigen target "X". In one embodiment, X is expressed on both normal cells and cancers cells, but is expressed at lower levels on normal cells. In one embodiment, the method further comprises selecting a SIR that binds X with an affinity that allows the XSIR to bind and kill the cancer cells expressing X but less than 30%, 25%, 20%, 15%, 10%, 5% or less of the normal cells expressing X are killed, e.g., as determined by an assay described herein. For example, the Gluc release cytotoxicity assay described herein can be used to identify XSIRs that target, e.g., the cancer cells. In one embodiment, the selected SIR has an antigen binding domain that has a binding affinity KD of about $10^{-4}$ M to $10^{-8}$ M, more commonly about $10^{-5}$ M to $10^{-7}$ M, and typically about $10^{-6}$ M or $10^{-7}$ M, for the target antigen. In one embodiment, the selected antigen binding domain has a binding affinity that is at least two-fold, five-fold, 10-fold, 20-fold, 30-fold, 50-fold, 100-fold or 1,000-fold less than a reference antibody, e.g., an antibody described herein and from which the binding domain of the SIR is derived.

In another embodiment, the disclosure provides methods of treating or preventing a disease by providing to the subject in need thereof immune effector cells (e.g., T cells) or stem cells that can give rise to immune effector cells that are engineered to express TCRB1-SIR, wherein the disease causing or disease associated cells express TCRB1 (T cell receptor Beta1 chain). In one embodiment, the disease to be treated or prevented is a cancer or immune disease. In one embodiment, the cancer to be treated or prevented is T cell leukemia or T cell lymphoma. In one embodiment, the immune disorder to be treated or prevented is multiple sclerosis, rheumatoid arthritis, ankylosing spondylitis, inflammatory Bowel Disease, Diabetes Mellitus, Graft vs host disease or autoimmune Thyroiditis.

In another embodiment, the disclosure provides methods of treating or preventing a disease by providing to the subject in need thereof immune effector cells (e.g., T cells) or stem cells that can give rise to immune effector cells that are engineered to express TCRB2-SIR, wherein the disease causing or disease associated cells express TCRB2 (T cell receptor Beta2 SIR). In one embodiment, the disease to be treated or prevented is a cancer or immune disorder. In one embodiment, the cancer to be treated or prevented is T cell leukemia or T cell lymphoma. In one embodiment, the immune disorder to be treated or prevented is multiple sclerosis, rheumatoid arthritis, ankylosing spondylitis, inflammatory Bowel Disease, Diabetes Mellitus, Graft vs host disease or autoimmune Thyroiditis.

In another embodiment, the disclosure provides methods of treating or preventing a disease by providing to the subject in need thereof immune effector cells (e.g., T cells) or stem cells that can give rise to immune effector cells that are engineered to express T cell receptor gamma-delta-SIR, wherein the disease causing or disease associated cells express T cell receptor gamma-delta. In one embodiment, the disease to be treated or prevented is a cancer or immune disorder. In one embodiment, the cancer to be treated or prevented is T cell leukemia or T cell lymphoma. In one embodiment, the immune disorder to be treated or prevented is multiple sclerosis, rheumatoid arthritis, ankylosing spondylitis, inflammatory bowel disease, diabetes mellitus, Graft vs host disease or autoimmune Thyroiditis.

In another embodiment, the disclosure provides methods of treating or preventing a disease by providing to the subject in need thereof immune effector cells (e.g., T cells) or stem cells that can give rise to immune effector cells that are engineered to express a SIR encoding CD4-DC-SIGN. In one embodiment, the disease to be treated or prevented is HIV1/AIDS.

In another embodiment, the disclosure provides methods of treating or preventing an autoimmune diseases by providing to the subject in need thereof immune effector cells (e.g., T cells) or stem cells that can give rise to immune effector cells that are engineered to express a SIR encoding the autoantigen or a fragment thereof. In one embodiment, the autoimmune disease is diabetes mellitus, rheumatoid arthritis, multiple sclerosis, pemphigus vulgaris, paraneoplastic pemphigous, glomerulonephritis, ankylosing spondylitis, Ulcerative Colitis or Crohn's disease. In one aspect, the disease is pemphigus vulgaris, and the antigen binding domain of the SIR comprises of extracellular domain of Desmoglein 3 (Dsg3)

In another embodiment, the disclosure provides methods of treating or preventing a cancer, infection, autoimmune or allergic diseases by providing to the subject in need thereof immune effector cells (e.g., T cells) or stem cells that can give rise to immune effector cells that are engineered to express a universal SIR encoding CD16 or a deletion- or point-mutant fragment thereof along with an antibody or an antibody fragment that binds to the CD16 domain of the SIR and an antigen expressed on the disease associated cells. In one aspect the disease associated cell is a cancer cell, an infected cell, or a plasma cell or a B cell or a T cell.

In another embodiment, the disclosure provides methods of treating or preventing a cancer, infection, autoimmune or allergic diseases by providing to the subject in need thereof immune effector cells (e.g., T cells) or stem cells that can give rise to immune effector cells that are engineered to express a universal SIR encoding an immunoglobulin binding receptor or a deletion- or point-mutant fragment thereof. The SIR-expressing immune effector cells are administered to the patient along with one or more antibodies or antibody fragments that bind to the immunoglobulin binding domain of the SIR receptor and with one or more antigens expressed on the disease associated cells. In one aspect the disease associated cell is a cancer cell, an infected cell, or a plasma cell or a B cell or a T cell.

In another embodiment, the disclosure provides methods of treating or preventing a cancer, infection, autoimmune or allergic diseases by providing to the subject in need thereof immune effector cells (e.g., T cells) or stem cells that can give rise to immune effector cells that are engineered to express both a universal SIR encoding an immunoglobulin binding receptor or a deletion- or point-mutant fragment thereof joined to a T cell receptor constant chain (e.g., constant chain of TCRα) and an antigen binding domain (e.g., a scFv, vHH, vL, vH, or a non-immunoglobulin antigen binding domain) joined to a T cell receptor constant chain (e.g. constant chain of TCRβ). The SIRs-expressing immune effector cells are administered to the patient along with one or more antibodies or antibody fragments that bind to the immunoglobulin binding domain of the first SIR receptor with one or more antigens expressed on the disease associated cells. In one aspect the disease associated cell is a cancer cell, an infected cell, or a plasma cell or a B cell or a T cell.

In another embodiment, the disclosure provides methods of treating or preventing a cancer, infection, autoimmune or allergic diseases by providing to the subject in need thereof immune effector cells (e.g., T cells) or stem cells that can give rise to immune effector cells that are engineered to express a universal SIR encoding an immunoglobulin receptor or a deletion- or point-mutant fragment thereof along with one or more antibodies or an antibody fragments that bind to the above receptor and one or more antigens expressed on the disease associated cells.

In another embodiment, the disclosure provides methods of treating or preventing a cancer, infection, autoimmune or allergic diseases by providing to the subject in need thereof immune effector cells (e.g., T cells) or stem cells that can give rise to immune effector cells that are engineered to express both a universal SIR encoding CD16 or a deletion- or point-mutant (e.g., V158 mutant) fragment thereof joined to a T cell receptor constant chain and a SIR encoding an antigen binding domain (e.g., a scFv, vHH, vL, vH, or a non-immunoglobulin antigen binding domain) joined to a T cell receptor constant chain. The SIRs-expressing immune effector cells are administered to the patient along with one or more antibody or an antibody fragments that binds to the CD16 domain of the SIR and one or more antigens expressed on the disease associated cells. In one aspect the disease associated cell is a cancer cell, an infected cell, or a plasma cell or a B cell or a T cell.

In another embodiment, the disclosure provides methods of treating or preventing a cancer, infection, autoimmune or allergic diseases by providing to the subject in need thereof immune effector cells (e.g., T cells) or stem cells that can give rise to immune effector cells that are engineered to express a universal SIR encoding CD16 or a deletion- or point-mutant fragment (e.g. V158 mutant) thereof along with one or more antibody or an antibody fragments that binds to the CD16 domain of the SIR and one or more antigens expressed on the disease associated cells. In one aspect the disease associated cell is a cancer cell, an infected cell, or a plasma cell or a B cell or a T cell.

In another embodiment, the disclosure provides methods of treating or preventing a cancer, infection, autoimmune or allergic diseases by providing to the subject in need thereof immune effector cells (e.g., T cells) that are engineered to express a SIR encoding NKG2D receptor or a deletion- or point-mutant fragment thereof. In one aspect the disease associated cell is a cancer cell, an infected cell, or a plasma cell or a B cell or a T cell.

In another embodiment, the disclosure provides methods of treating or preventing a disease by providing to the subject in need thereof immune effector cells (e.g., T cells) or stem cells that can give rise to immune effector cells that are engineered to express CD19SIR. In one aspect the disease is an immune or allergic disease.

In another embodiment, the disclosure provides methods of treating or preventing a disease by providing to the subject in need thereof immune effector cells (e.g., T cells) that are engineered to express CD20SIR. In one aspect the disease is an immune or allergic disease.

In another embodiment, the disclosure provides methods of treating or preventing a disease by providing to the subject in need thereof immune effector cells (e.g., T cells) that are engineered to express CD22SIR. In one aspect the disease is an immune or allergic disease.

In another embodiment, the disclosure provides methods of treating or preventing a cancer, infection, autoimmune or allergic diseases by providing to the subject in need thereof immune effector cells (e.g., T cells) or stem cells that can give rise to immune effector cells that are engineered to express a FITC-SIR along with a FITC-labelled antibody or an antibody fragment or an antibody fragment or a receptor or a ligand or a non-Immunoglobulin scaffold that binds to an antigen expressed on the disease associated cells. In one aspect the disease associated cell is a cancer cell, an infected cell, or a plasma cell or a B cell or a T cell.

In another embodiment, the disclosure provides methods of treating or preventing a cancer, infection, autoimmune or allergic diseases by providing to the subject in need thereof immune effector cells (e.g., T cells) or stem cells that can give rise to immune effector cells that are engineered to express an avidin-SIR along with a Biotin-labelled antibody or an antibody fragment or an antibody fragment or a receptor or a ligand or a non-Immunoglobulin scaffold that binds to an antigen expressed on the disease associated cells. In one aspect the disease associated cell is a cancer cell, an infected cell, or a plasma cell.

In another embodiment, the disclosure provides methods of treating or preventing a cancer, infection, autoimmune or allergic diseases by providing to the subject in need thereof immune effector cells (e.g., T cells) or stem cells that can give rise to immune effector cells that are engineered to express an Streptag-SIR along with a Streptag-containing antibody or an antibody fragment or a receptor or a ligand or a non-Immunoglobulin scaffold that binds to an antigen expressed on the disease associated cells. In one aspect the disease associated cell is a cancer cell, an infected cell, or a plasma cell.

In another embodiment, the disclosure provides methods of treating or preventing a disease by providing to the subject in need thereof immune effector cells (e.g., T cells) that are engineered to express IgE-SIR whose antigen binding domain comprises of an antibody or antibody fragment that binds to IgE. In one aspect the disease is an immune or allergic disease.

In another embodiment, the disclosure relates to treatment of a subject in vivo using a PD1SIR (i.e., a SIR containing the extracellular domain of PD1 as its antigen binding domain) such that growth of cancerous tumors is inhibited. The nucleic acid sequence of an exemplary PD1-SIR is provided in SEQ ID NO. 1337. A PD1SIR may be used alone to inhibit the growth of cancerous tumors. Alternatively, PD1SIR may be used in conjunction with other SIRs, CARs, immunogenic agents, standard cancer treatments, or other antibodies. In one embodiment, the subject is treated with a PD1SIR and an XSIR described herein. In another embodiment, a PD1SIR is used in conjunction with another SIR or CAR, e.g., a SIR or a CAR described herein, and a kinase inhibitor, e.g., a kinase inhibitor described herein.

In another embodiment, the disclosure relates to treatment of a subject in vivo using an XSIR and a PD1-CAR or a CTL4-CAR such that growth of cancerous tumors is inhibited. In one embodiment, the subject is treated with a PD1-CAR or a CTLA4-CAR and an XSIR described herein. The nucleic acid sequence of exemplary constructs encoding a PD1-CAR and a XSIR (e.g., CD19-SIR) are provided in SEQ ID NO: 982-984. The nucleic acid sequences of exemplary constructs encoding a CTLA4-CAR and a XSIR (e.g., CD19-SIR) are provided in SEQ ID NO: 986-987. In another embodiment, a PD1-CAR is used in conjunction with another SIR or CAR, e.g., a SIR or a CAR described herein, and a kinase inhibitor, e.g., a kinase inhibitor described herein. In one embodiment, an XSIR is used in conjunction with a PD1-CAR or a CTL4-CAR.

In another aspect, a method of treating a subject, e.g., reducing or ameliorating a hyperproliferative disorder or condition (e.g., a cancer), e.g., solid tumor, a soft tissue tumor, a blood cancer, or a metastatic lesion, in a subject is provided. As used herein, the term "cancer" is meant to include all types of cancerous growths or oncogenic processes, metastatic tissues or malignantly transformed cells, tissues, or organs, irrespective of histopathologic type or stage of invasiveness. Exemplary solid tumors include malignancies, e.g., adenocarcinomas, sarcomas, and carcinomas, of the various organ systems, such as those affecting breast, liver, lung, brain, lymphoid, gastrointestinal (e.g., colon), genitourinary tract (e.g., renal, urothelial cells), prostate and pharynx. Adenocarcinomas include cancers such as most colon cancers, rectal cancer, renal-cell carcinoma, liver cancer, non-small cell carcinoma of the lung, cancer of the small intestine and cancer of the esophagus. In one embodiment, the cancer is a melanoma, e.g., an advanced stage melanoma. Metastatic lesions of the aforementioned cancers can also be treated or prevented using the methods and compositions of the disclosure. Examples of other cancers that can be treated or prevented include pancreatic cancer, bone cancer, skin cancer, cutaneous or intraocular malignant melanoma, uterine cancer, ovarian cancer, rectal cancer, cancer of the head or neck, cancer of the anal region, stomach cancer, testicular cancer, uterine cancer, carcinoma of the fallopian tubes, carcinoma of the endometrium, carcinoma of the cervix, carcinoma of the vagina, carcinoma of the vulva, Hodgkin Disease, non-Hodgkin lymphoma, cancer of the esophagus, cancer of the small intestine, cancer of the endocrine system, cancer of the thyroid gland, cancer of the parathyroid gland, cancer of the adrenal gland, sarcoma of soft tissue, cancer of the urethra, cancer of the penis, chronic or acute leukemias including acute myeloid leukemia, chronic myeloid leukemia, acute lymphoblastic leukemia, chronic lymphocytic leukemia, solid tumors of childhood, lymphocytic lymphoma, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers including those induced by asbestos, and combinations of said cancers. Treatment of metastatic cancers, e.g., metastatic cancers that express PD-L1 (Iwai et al. (2005) Int. Immunol. 17:133-144) can be effected using the antibody molecules described herein.

Exemplary cancers whose growth can be inhibited include cancers typically responsive to immunotherapy. Non-limiting examples of cancers for treatment include renal cancer (e.g. clear cell carcinoma), melanoma (e.g., metastatic malignant melanoma), breast cancer, prostate cancer (e.g. hormone refractory prostate adenocarcinoma), colon cancer and lung cancer (e.g. non-small cell lung cancer). Additionally, recurrent or are refractory malignancies can be treated using the molecules described herein.

In one embodiment, the disclosure pertains to a vector comprising a SIR operably linked to promoter for expression in mammalian immune effector cells (e.g., T cells) or stem cells that can give rise to immune effector cells. In one aspect, the disclosure provides a recombinant immune effector cell expressing a SIR of the present invention for use in treating or preventing cancer expressing a cancer associate antigen as described herein. In one aspect, SIR-expressing cells of the disclosure is capable of contacting a tumor cell with at least one cancer associated antigen expressed on its surface such that the SIR-expressing cell targets the cancer cell and growth of the cancer is inhibited. In one aspect, the disclosure provides a recombinant immune effector cell expressing a SIR of the present invention for use in treating or preventing a disease expressing a disease associate antigen as described herein. In one aspect, SIR-expressing cell of the disclosure is capable of contacting a disease causing or a disease associated cell with at least one disease associated antigen expressed on its surface such that the SIR-expressing cell targets the disease causing or disease associated cell and growth of the disease is inhibited.

In one embodiment, the disclosure pertains to a method of inhibiting growth of a disease (e.g., cancer, autoimmune disease, infectious disease or allergic disease or a degenerative disease), comprising contacting the disease causing or disease associated cell with a SIR-expressing cell of the present invention such that the SIRT is activated in response to the antigen and targets the disease causing or disease associated cell, wherein the growth of the disease causing or disease associated cell is inhibited. In one aspect, the disclosure pertains to a method of preventing a disease, comprising administering to a patient at risk of disease a SIR-expressing cell or a cell that is capable of generating a SIR-expressing cell of the present invention such that the SIRT is activated in response to the antigen and targets the disease causing or disease associated cell, wherein the growth of the disease causing or disease associated cell is prevented. In one aspect the disease is a cancer, an infectious disease, an immune disease, an allergic disease, or a degenerative disease.

In another embodiment, the disclosure pertains to a method of treating cancer in a subject. The method comprises administering to the subject SIR-expressing cell of the present invention such that the cancer is treated in the subject. In one aspect, the cancer associated with expression of a cancer associate antigen as described herein is a blood or hematological cancer. In one aspect, the hematological cancer is leukemia or lymphoma. In one aspect, a cancer associated with expression of a cancer associate antigen as described herein includes cancers and malignancies including, but not limited to, e.g., one or more acute leukemias including but not limited to, e.g., B-cell acute Lymphoid Leukemia ("BALL"), pre-B cells Acute Lymphocytic Leukemia, T-cell acute Lymphoid Leukemia ("TALL"), acute lymphoid leukemia (ALL); one or more chronic leukemias including but not limited to, e.g., chronic myelogenous leukemia (CML), Chronic Lymphoid Leukemia (CLL). Additional cancers or hematologic conditions associated with expression of a cancer associate antigen as described herein include, but are not limited to, e.g., B cell prolymphocytic leukemia, blastic plasmacytoid dendritic cell neoplasm, Burkitt's lymphoma, diffuse large B cell lymphoma, Follicular lymphoma, Hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like. Further a disease associated with a cancer associate antigen as described herein expression include, but not limited to, e.g., atypical and/or non-classical cancers, malignancies, precancerous conditions or proliferative diseases associated with expression of a cancer associate antigen as described herein.

In yet another embodiment, the disclosure pertains to a method of treating a disease in a subject. The method comprises administering to the subject SIR-expressing cell of the present invention such that the disease is treated in the subject. In one aspect, the disease associated with expression of a disease associate antigen as described herein is an infectious disease. In one aspect the infectious disease is disease associated with infection by HIV1, HIV2, HTLV1, Epstein Barr virus (EBV), cytomegalovirus (CMV), adenovirus, adeno-associated virus, BK virus, Human Herpesvirus 6, Human Herpesvirus 8, influenza A virus, influenza B virus parainfluenza virus, avian flu virus, MERS and SARS coronaviruses, Crimean Congo Hemorrhagic fever virus, rhino virus, enterovirus, Dengue virus, West Nile virus, Ebola virus, Marburg virus, Lassa fever virus, zika virus, RSV, measles virus, mumps virus, rhino virus, varicella virus, herpes simplex virus 1 and 2, varicella zoster virus, HIV-1, HTLV1, Hepatitis virus, enterovirus, hepatitis B virus, Hepatitis C virus, Nipah and Rift valley fever viruses, Japanese encephalitis virus, *Mycobacterium tuberculosis*, atypical mycobacteria species, *Pneumocystis jirovecii*, toxoplasmosis, *Rickettsia, Nocardia, Aspergillus, Mucor,* or *Candida.*

In yet another embodiment, the disclosure pertains to a method of treating a disease in a subject. The method comprises administering to the subject SIR-expressing cell of the present invention such that the disease is treated in the subject. In one aspect, the disease associated with expression of a disease associate antigen as described herein is an immune or allergic or generative disease. In one aspect the immune or degenerative disease is diabetes mellitus, multiple sclerosis, rheumatoid arthritis, pemphigus vulgaris, ankylosing spondylitis, Hoshimoto's thyroiditis, SLE, sarcoidosis, scleroderma, mixed connective tissue disease, graft versus host disease, peanut allergy, chronic spontaneous urticaria, food allergy, hay fever, seasonal allergy, pollen allergy, HLH (hemophagocytic lymphohistiocytosis), amyloidosis or Alzheimer's disease.

In some embodiments, a cancer that can be treated or prevented with SIR-expressing cell of the present invention is multiple myeloma. Multiple myeloma is a cancer characterized by accumulation of a plasma cell clone in the bone marrow. Current therapies for multiple myeloma include, but are not limited to, treatment with lenalidomide, which is an analog of thalidomide. Lenalidomide has activities which include anti-tumor activity, angiogenesis inhibition, and immunomodulation. Generally, myeloma cells are thought to be negative for a cancer associate antigen CD19 as described herein expression by flow cytometry. Therefore, in some embodiments, a CD19SIR, e.g., as described herein, may be used to target myeloma cells. In some embodiments, SIRs of the present invention therapy can be used in combination with one or more additional therapies, e.g., lenalidomide treatment. Other SIR described in this invention, e.g., BCMA-SIR, CD138-SIR, CS1-SIR, GPRC5D-SIR etc., can be also used for the treatment or prevention of multiple myeloma.

The disclosure includes a type of cellular therapy where immune effector cells (e.g., T cells or stem cells that give rise to T cells) are genetically modified to express a synthetic antigen receptor (SIR) and the SIR-expressing T cell or stem cell is infused to a recipient in need thereof. The infused cell is able to kill disease associated cells (e.g., tumor cells or virally infected cells) in the recipient. Unlike antibody therapies, SIR-modified immune effector cells (e.g., T cells, stem cells) are able to replicate in vivo resulting in long-term persistence that can lead to sustained tumor control. In various aspects, the immune effector cells (e.g., T cells or stem cells that can give rise to T cells) administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty three months, two years, three years, four years, or five years after administration of the T cell or stem cells to the patient.

The disclosure also includes a type of cellular therapy where immune effector cells (e.g., T cells) are modified, e.g., by in vitro transcribed RNA, to transiently express a synthetic antigen receptor (SIR) and the SIRT cell is infused to a recipient in need thereof. The infused cell is able to kill disease associated cells (e.g., tumor cells or virally infected cells) in the recipient. Thus, in various aspects, the immune effector cells (e.g., T cells) administered to the patient, is present for less than one month, e.g., three weeks, two weeks, one week, after administration of the T cell to the patient.

The disclosure also includes a type of cellular therapy where stem cells (e.g., hematopoietic stem cell or lymphoid stem cells or embryonic stem cells, or induced pluripotent stem cells) that are capable of giving rise to immune effector cells (e.g., T cells) are modified to express a synthetic antigen receptor (SIR) and are administered to a recipient in need thereof. The administered stem cells give rise to immune effector cells (e.g., T cells) after transplantation into the recipient, which (i.e. the immune effector cells) are able to kill disease associated cells in the recipient. Thus, in various aspects, the immune effector cells (e.g., T cells) that are produced in the patient after administration of SIR-expressing stem cells, persist in the patient for at least one week, 2 weeks, 3 weeks, one month, two months, three months, four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, five years, ten years or twenty years after administration of the T cell or stem cells to the patient. The disclosure also includes a type of cellular therapy where stem cells that are capable of giving rise to immune effector cells (e.g., T cells) are modified to express a synthetic antigen receptor (SIR) and are differentiated in vitro to generate immune effector cells that are infused to a recipient in need thereof. The infused immune effector cells (e.g., T cells) after infusion into the recipient are able to kill disease associated cells in the recipient. Thus, in various aspects, the immune effector cells (e.g., T cells) that are administered to the patient persist in the patient for at least 1 day, 2 days, 3 days, 4 days, 5 days, 6 days, one week, 2 weeks, 3 weeks, one month, two months, three months, four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty three months, two years, three years, four years, five years, ten years or twenty years.

The disclosure also includes a type of cellular therapy where immune effector cells (e.g., T cells) are modified to express a SIR encoding an autoantigen (e.g., Dsg3 or Dsg1). Such autoantigen expressing SIR of the disclosure can be used to eradicate a B cells and plasma cells that express an autoantibody against the autoantigen. Such autoantigen-SIR can be used for the treatment and prevention of autoimmune disorders, such as pumphigous vulgaris.

The disclosure also includes a type of cellular therapy where regulatory immune effector cells (e.g., $T_{REG}$, or CD25+ T Cells) are modified to express a SIR targeting a specific antigen. Such SIR-$T_{REG}$ are administered to a patient to suppress immune response against the specific antigen. The SIR-$T_{REG}$ can be used to prevent and treat autoimmune diseases and to enhance immune tolerance. Without wishing to be bound by any particular theory, the anti-tumor immunity response elicited by the SIR-modified immune effector cells (e.g., T cells) may be an active or a passive immune response, or alternatively may be due to a direct vs indirect immune response. In one aspect, the SIR transduced immune effector cells (e.g., T cells) exhibit specific pro inflammatory cytokine secretion and potent cytolytic activity in response to human diseased cells (e.g., cancer or infected cells) expressing the a disease associate antigen as described herein, resist soluble disease associate antigen as described herein, mediate bystander killing and mediate regression of an established human disease, including cancer. For example, antigen-less tumor cells within a heterogeneous field of a cancer associate antigen as described herein-expressing tumor may be susceptible to indirect destruction by a cancer associate antigen as described herein-redirected immune effector cells (e.g., T cells) that has previously reacted against adjacent antigen-positive cancer cells.

In one aspect, the fully-human SIR-modified immune effector cells (e.g., T cells) of the disclosure may be a type of vaccine for ex vivo immunization and/or in vivo therapy in a mammal. In one aspect, the mammal is a human. In one aspect, the mammal is a dog.

With respect to ex vivo immunization, at least one of the following occurs in vitro prior to administering the cell into a mammal: i) expansion of the cells, ii) introducing a nucleic acid encoding a SIR to the cells or iii) cryopreservation of the cells.

Ex vivo procedures are well known in the art and are discussed more fully below. Briefly, cells are isolated from a mammal (e.g., a human) and genetically modified (i.e., transduced or transfected in vitro) with a vector expressing a SIR disclosed herein. The SIR-modified cell can be administered to a mammalian recipient to provide a therapeutic benefit. The mammalian recipient may be a human and the SIR-modified cell can be autologous with respect to the recipient. Alternatively, the cells can be allogeneic, syngeneic or xenogeneic with respect to the recipient.

In another embodiment, the SIR-modified cells are used ex vivo to purge the bone marrow or peripheral blood hematopoietic stem cells of disease-associated cells (e.g. cancer cells). As an example, T cells expressing CD19-SIR are cocultured with bone marrow or peripheral blood stem cell sample taken from a patient with acute lymphocytic leukemia or non-Hodgkin lymphoma so as to kill off any leukemia or lymphoma cells present in the bone marrow or peripheral blood stem cell preparation. After a suitable duration of culture in vitro (ex vivo), which may range from a 6 hours to several days, the purged bone marrow and peripheral blood sample is used for autologous transplant in the patient.

The procedure for ex vivo expansion of hematopoietic stem and progenitor cells is described in U.S. Pat. No. 5,199,942, incorporated herein by reference, can be applied to the cells of the present invention. Other suitable methods are known in the art, therefore the present invention is not limited to any particular method of ex vivo expansion of the cells. Briefly, ex vivo culture and expansion of immune effector cells (e.g., T cells) comprises: (1) collecting CD34+ hematopoietic stem and progenitor cells from a mammal from peripheral blood harvest or bone marrow explants; and (2) expanding such cells ex vivo. In addition to the cellular growth factors described in U.S. Pat. No. 5,199,942, other factors such as flt3-L, IL-1, IL-3 and c-kit ligand, can be used for culturing and expansion of the cells.

In addition to using a cell-based vaccine in terms of ex vivo immunization, the present invention also provides compositions and methods for in vivo immunization to elicit an immune response directed against an antigen in a patient.

Generally, the cells activated and expanded as described herein may be utilized in the treatment and prevention of diseases that arise in individuals who are immunocompromised. In particular, the SIR-modified immune effector cells (e.g., T cells) of the disclosure are used in the treatment of diseases, disorders and conditions associated with expression of a disease associate antigen (e.g., cancer antigen or a viral antigen) as described herein. In certain aspects, the cells of the disclosure are used in the treatment of patients at risk for developing diseases, disorders and conditions associated with expression of a disease associate antigen as described herein. Thus, the disclosure provides methods for the treatment or prevention of diseases, disorders and conditions associated with expression of a disease associate antigen as described herein comprising administering to a subject in need thereof, a therapeutically effective amount of the SIR-modified immune effector cells (e.g., T cells) or stem cells that are capable of generating immune effector cells of the disclosure.

In one aspect the SIR-expressing cells of the disclosures may be used to treat a proliferative disease such as a cancer or malignancy or is a precancerous condition such as a myelodysplasia, a myelodysplastic syndrome or a preleukemia. Further a disease associated with a cancer associate antigen as described herein expression include, but not limited to, e.g., atypical and/or non-classical cancers, malignancies, precancerous conditions or proliferative diseases expressing a cancer associated antigen as described herein. Noncancer related indications associated with expression of a disease associate antigen as described herein include, but are not limited to, e.g., autoimmune disease, (e.g., lupus), inflammatory disorders (allergy and asthma), infectious conditions (e.g., HIV1, CMV, EBV, influenza) and transplantation.

The SIR-modified immune effector cells (e.g., T cells) of the disclosure may be administered either alone, or as a pharmaceutical composition in combination with diluents and/or with other components such as IL-2 or other cytokines or cell populations.

Hematological cancer or blood cancer conditions are the types of cancer such as leukemia, lymphoma, and malignant lymphoproliferative conditions that affect blood, bone marrow and the lymphatic system.

Leukemia can be classified as acute leukemia and chronic leukemia. Acute leukemia can be further classified as acute myelogenous leukemia (AML) and acute lymphoid leukemia (ALL). Chronic leukemia includes chronic myelogenous leukemia (CML) and chronic lymphoid leukemia (CLL). Other related conditions include myelodysplastic syndromes (MDS, formerly known as "preleukemia") which are a diverse collection of hematological conditions united by ineffective production (or dysplasia) of myeloid blood cells and risk of transformation to AML.

Lymphoma is a group of blood cell tumors that develop from lymphocytes. Exemplary lymphomas include non-Hodgkin lymphoma and Hodgkin lymphoma.

The present invention provides for compositions and methods for treating and preventing cancer. In one aspect, the cancer is a hematologic cancer or blood cancer including but is not limited to hematological cancer is a leukemia or a lymphoma. In one aspect, the SIR-expressing cells of the disclosure may be used to treat cancers and malignancies such as, but not limited to, e.g., acute leukemias including but not limited to, e.g., B-cell acute lymphoid leukemia ("BALL"), T-cell acute lymphoid leukemia ("TALL"), acute lymphoid leukemia (ALL); one or more chronic leukemias including but not limited to, e.g., chronic myelogenous leukemia (CML), chronic lymphocytic leukemia (CLL); additional hematologic cancers or hematologic conditions including, but not limited to, e.g., B cell prolymphocytic leukemia, blastic plasmacytoid dendritic cell neoplasm, Burkitt's lymphoma, diffuse large B cell lymphoma, Follicular lymphoma, Hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like. Further a disease associated with a cancer associate antigen as described herein expression includes, but not limited to, e.g., atypical and/or non-classical cancers, malignancies, precancerous conditions or proliferative diseases expressing a cancer associate antigen as described herein.

The disclosure also provides methods for inhibiting the proliferation or reducing a disease associated antigen as described herein-expressing cell population, the methods comprising contacting a population of cells comprising a disease associated antigen as described herein-expressing cell with a SIR-expressing T cell of the disclosure that binds to the a disease associate antigen as described herein-expressing cell. In a specific aspect, the present invention provides methods for inhibiting the proliferation or reducing the population of diseased cells expressing a disease associated antigen as described herein, the methods comprising contacting a disease associate antigen as described herein expressing cancer cell population with a SIR-expressing T cell of the disclosure that binds to a disease associated antigen as described herein-expressing cell. In one aspect, the present invention provides methods for inhibiting the proliferation or reducing the population of diseased cells expressing a disease associated antigen as described herein, the methods comprising contacting a disease associated antigen as described herein-expressing diseased cell population with a SIR-expressing T cell of the disclosure that binds to a diseased associated antigen as described herein-expressing cell. In certain aspects, a SIR-expressing T cell of the disclosure reduces the quantity, number, amount or percentage of cells and/or diseased cells by at least 25%, at least 30%, at least 40%, at least 50%, at least 65%, at least 75%, at least 85%, at least 95%, or at least 99% in a subject with or animal model for myeloid leukemia or another disease associated with a disease associated antigen as described herein-expressing cells relative to a negative control. In one aspect, the subject is a human. In one aspect the disease is cancer, infectious disease, immune disease, allergy or degenerative disease.

The disclosure also provides methods for preventing, treating and/or managing a disease associated with a disease associated antigen as described herein expressing cells (e.g., a hematologic cancer or atypical cancer or infectious disease or immune disease or allergic disease or degenerative disease expressing a disease associated antigen as described herein), the methods comprising administering to a subject in need a SIR T cell of the disclosure that binds to a disease associated antigen as described herein-expressing cell. In one aspect, the subject is a human. Non-limiting examples of disorders associated with a disease associated antigen as described herein expressing cells include autoimmune disorders (such as lupus), inflammatory disorders (such as allergies and asthma), infections (such as HIV1, HTLV1, Influenza, CMV, Adenovirus, EBV and HHV8) and cancers (such as hematological cancers or atypical cancers expressing a cancer associated antigen as described herein).

The disclosure also provides methods for preventing, treating and/or managing a disease associated with a disease associated antigen as described herein expressing cells, the methods comprising administering to a subject in need a SIR T cell of the disclosure that binds to a disease associated antigen as described herein expressing cell. In one aspect, the subject is a human.

The disclosure provides methods for preventing relapse of disease associated with a disease associated antigen as described herein-expressing cells, the methods comprising administering to a subject in need thereof a SIR T cell of the disclosure that binds to a disease associated antigen as described herein-expressing cell. In one aspect, the methods comprise administering to the subject in need thereof an effective amount of a SIR-expressing T cell described herein that binds to a disease associated antigen as described herein-expressing cell in combination with an effective amount of another therapy.

The disclosure also provides a method of treating or preventing a disease in a subject having a disease or an increased risk of a disease associated with expression of a target antigen comprising administering to the subject an effective amount of a cell comprising a SIR molecule.

The disclosure also provides a method of treating a subject or preventing a disease in a subject having a disease or an increased risk of a disease associated with expression of a target antigen, comprising administering to the subject an effective amount of a cell, e.g., an immune effector cell (e.g., a population of immune effector cells) comprising a SIR molecule, wherein the SIR molecule comprises one or more antigen binding domains, and one or more T cell receptor constant chains, wherein said antigen binding domain binds to the target antigen associated with the disease. Non-limiting examples of target antigens are disclosed herein above.

The disclosure provide a method of administering to a subject an effective amount of a cell, e.g., an immune effector cell, or a population thereof, each cell comprising a SIR molecule, optionally in combination with an agent that increases the efficacy and/or safety of the immune cell. In various embodiments, the agent that increases the efficacy and/or safety of the immune cell is selected from the group consisting of (i) a protein phosphatase inhibitor; (ii) a kinase inhibitor; (iii) a cytokine; (iv) an inhibitor of an immune inhibitory molecule; (v) an agent that decreases the level or activity of a $T_{REG}$ cell; (vi) an agent that increase the proliferation and/or persistence of SIR-modified cells; (vii) a chemokine; (viii) an agent that increases the expression of SIR; (ix) an agent that allows regulation of the expression or activity of SIR; (x) an agent that allows control over the survival and/or persistence of SIR-modified cells; (xi) an agent that controls the side effects of SIR-modified cells; (xii) a Brd4 inhibitor; (xiii) an agent that delivers a therapeutic (e.g. sHVEM) or prophylactic agent to the site of the disease; (xiv) an agent that increases the expression of the target antigen against which SIR is directed; (xv) an adenosine A2a receptor antagonist; and (xvi) any combination of (i)-(xv).

In some embodiments, the disease to be treated or prevented is a hematologic cancer. In further embodiments, the hematologic cancer is leukemia. Non-limiting examples of acute leukemias include B-cell acute lymphoid leukemia ("BALL"), T-cell acute lymphoid leukemia ("TALL"), acute lymphoid leukemia (ALL); one or more chronic leukemias including but not limited to chronic myelogenous leukemia (CML), chronic lymphocytic leukemia (CLL); additional hematologic cancers or hematologic conditions including, but not limited to B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, nonHodgkin lymphoma, Hodgkin lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and to disease associated with expression of a tumor antigen described herein include, but not limited to, atypical and/or non-classical cancers, malignancies, precancerous conditions or proliferative diseases expressing a tumor antigen as described herein; and any combination thereof. In another embodiment, the disease associated with a tumor antigen described herein is a solid tumor.

In some embodiments, the tumor antigen associated with the disease is selected from: CD5, CD19, CD123, CD22, CD23, CD30, CD171, CS-1, CLL-1 (CLECL1), CD33, EGFRviii, GD2, GD3, BCMA, Tn Ag, PSMA, ROR1, FLT3, TAG72, CD38, CD44v6, CEA, EPCAM, B7H3, KIT, IL-13Ra2, Mesothelin, IL-11Ra, PSCA, PRSS21, VEGFR2, LewisY, CD24, PDGFR-beta, SSEA-4, CD20, Folate receptor alpha, ERBB2 (Her2/neu), MUC1, EGFR, NCAM, Prostase, PAP, ELF2M, Ephrin B2, FAP, IGF-I receptor, CAIX, LMP2, gp100, bcr-abl, tyrosinase, EphA2, Fucosyl GM1, sLe, GM3, TGS5, HMWMAA, o-acetyl-GD2, Folate receptor beta, TEM1/CD248, TEM7R, CLDN6, TSHR, GPRC5D, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, NY-ES0-1, LAGE-1a, MAGE-A1, MAGE A1, ETV6-AML, sperm protein 17, XAGE1, Tie 2, MAD-CT-1, MAD-CT-2, Fos-related antigen 1, p53, p53 mutant, prostein, survivin and telomerase, PCTA-1/Galectin 8, MelanA/MART1, Ras mutant, hTERT, sarcoma translocation breakpoints, ML-IAP, ERG (TMPRSS2 ETS fusion gene), NA17, PAX3, Androgen receptor, Cyclin B1, MYCN, RhoC, TRP-2, CYP1B1, BORIS, SART3, PAX5, OY-TES1, LCK, AKAP-4, SSX2, RAGE-1, human telomerase reverse transcriptase, RU1, RU2, legumain, HPV E6, E7, intestinal carboxyl esterase, mut hsp70-2, CD79a, CD79b, CD72, LAIR1, FCAR, LILRA2, CD300LF, CLEC12A, BST2, EMR2, LY75, FCRL5, IGLL1, MPL, FITC, Biotin, c-MYC epitope Tag, CD34, LAMP1, TROP2, GFRalpha4, CDH17, CDH6, NYBR1, CDH19, CD200R, Slea (CA19.9; Sialyl Lewis Antigen), PTK7, gpNMB, CDH1-CD324, DLL3, CD276/B7H3, IL11Ra, IL13Ra2, CD179b-IGLl1, ALK, TCR-gamma-delta, NKG2D, CD32 (FCGR2A), Tn ag, CSPG4-HMW-MAA, Tim1-/HVCR1, CSF2RA (GM-CSFR-alpha), TGFbetaR2, VEGFR2/KDR, Lews Ag, TCR-beta1 chain, TCR-beta2 chain, TCR-gamma chain, TCR-delta chain, FITC, Leutenizing hormone receptor (LHR), CCR4, GD3, GLYPICAN-3 (GPC3), SLAMF6, SLAMF4, HTLV1-Tax, EBV-EBNA3c, HLA, HLA-A, HLA-A2, HLA-B, HLA-C, HLA-DP, HLA-DM, HLA-DOA, HLA-DOB, HLA-DQ, HLA-DR, HLA-G, IGE, CD99, RAS G12V, TISSUE FACTOR 1 (TF1), AFP, GPRC5D, CLAUDIN18.2 (CLD18A2 OR CLDN18A.2)), P-GLYCOPROTEIN, STEAP1, LIV1, NECTIN-4, CRIPTO, GPA33, BST1/CD157, LOW CONDUCTANCE CHLORIDE CHANNEL, antigen recognized by TNT antibody, TSHR, CD 171, CS-1, CLL-1, GD3, Tn Ag, FLT3, CD38, CD44v6, a glycosylated CD43 epitope expressed on acute leukemia or lymphoma but not on hematopoietic progenitors, a glycosylated CD43 epitope expressed on non-hematopoietic cancers, B7H3, KIT, IL-13Ra2, IL-llRa, PSCA, PRSS21, VEGFR2, LewisY, CD24, PDGFR-beta, SSEA-4, MUC1, EGFR, NCAM, CAX, LMP2, EphA2, Fucosyl GM1, sLe, GM3, TGS5, HMWMAA, o-acetyl-GD2, Folate receptor beta, TEM1/CD248, TEM7R, CLDN6, GPRC5D, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, ETV6-AML, sperm protein 17, XAGE1, Tie 2, MAD-CT-1, MAD-CT-2, Fos-related antigen 1, p53 mutant, hTERT, sarcoma translocation breakpoints, ML-IAP, ERG (TMPRSS2 ETS fusion gene), NA17, PAX3, Androgen receptor, Cyclin B1, MYCN, RhoC, CYP1B1, BORIS, SART3, PAX5, OY-TES1, LCK, AKAP-4, SSX2, CD79a, CD79b, CD72, LAIR1, FCAR, LILRA2, CD300LF, CLEC12A, BST2, EMR2, LY75, GPC3, FCRL5, IGLL1, TSHR, CLDN6, GPRC5D, CXORF61, CD97, CD179a, ALK, Polysialic acid, PLAC1, GloboH, NY-BR-1, UPK2, HAVCR1, ADRB3, PANX3, GPR20, LY6K, and OR51E2.

In some embodiments, the disease to be treated is an infectious disease including, but not limited to, infection by HIV1, HIV2, HTLV1, Epstein Barr virus (EBV), cytomegalovirus (CMV), adenovirus, adeno-associated virus, BK virus, Human Herpesvirus 6, Human Herpesvirus 8 influenza virus, parainfluenza virus, avian flu virus, MERS and SARS coronaviruses, Crimean Congo Hemorrhagic fever virus, rhino virus, enterovirus, Dengue virus, West Nile virus, Ebola virus, Marburg virus, Lassa fever virus, zika virus, RSV, measles virus, mumps virus, rhino virus, varicella virus, herpes simplex virus 1 and 2, varicella zoster virus, HIV-1, HTLV1, Hepatitis virus, enterovirus, hepatitis B virus, Hepatitis C virus, Nipah and Rift valley fever viruses, Japanese encephalitis virus, *Mycobacterium tuberculosis*, atypical mycobacteria species, *Pneumocystis jirovecii*, toxoplasmosis, *Rickettsia, Nocardia, Aspergillus, Mucor*, or *Candida*. In such diseases, the target antigen associated with the disease is selected from: HIV1 envelope glycoprotein, HIV1-gag, HTLV1-Tax, CMV pp65, EBV-EBNA3c, influenza A hemagglutinin (HA) and GAD.

The disease to be treated or prevented by the methods and compositions of the disclosure can be an immune or degenerative disease, e.g., diabetes mellitus, multiple sclerosis, rheumatoid arthritis, pemphigus vulgaris, ankylosing spondylitis, Hoshimoto's thyroiditis, SLE, sarcoidosis, scleroderma, mixed connective tissue disease, graft versus host disease or Alzheimer's disease. In such embodiments, the target antigen associated with the disease is an autoantibody. Exemplary autoantibodies that are suitable targets for SIR are autoantibodies against Dsg3 or Dsg1.

Further non-limiting examples of diseases associated with expression of a target antigen include any one of the following cancers or related conditions: colon cancer, rectal cancer, renal-cell carcinoma, liver cancer, non-small cell carcinoma of the lung, cancer of the small intestine, cancer of the esophagus, melanoma, bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, uterine cancer, carcinoma of the fallopian tubes, carcinoma of the endometrium, carcinoma of the cervix, carcinoma of the vagina, carcinoma of the vulva, Hodgkin's Disease, non-Hodgkin's lymphoma, cancer of the endocrine system, cancer of the thyroid gland, cancer of the parathyroid gland, cancer of the adrenal gland, sarcoma of soft tissue, cancer of the urethra, cancer of the penis, solid tumors of childhood, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers, combinations of said cancers, and metastatic lesions of said cancers.

In certain embodiments of the methods or uses described herein, the SIR molecule is administered in combination with an agent that increases the efficacy of the immune effector cell, e.g., one or more of a protein phosphatase inhibitor, a kinase inhibitor, a cytokine, a chemokine, a scFV fragment, a bispecific antibody, an inhibitor of an immune inhibitory molecule; a cellular signaling protein, a viral signaling protein, or an agent that decreases the level or activity of a $T_{REG}$ cell. Non-limiting examples of protein phosphatase inhibitors include a SHP-1 inhibitor and/or an SHP-2 inhibitor. Non-limiting examples of kinase inhibitors include a CDK4 inhibitor, a CDK4/6 inhibitor (e.g., palbociclib), a BTK inhibitor (e.g., ibrutinib or RN-486), an mTOR inhibitor (e.g., rapamycin or everolimus (RAD001)), an MNK inhibitor, or a dual P13K/mTOR inhibitor. In one embodiment, the BTK inhibitor does not reduce or inhibit the kinase activity of interleukin-2-inducible kinase (ITK). Non limiting examples of an A2a receptor antagonist include Vipadenant. In some embodiments, the agent that inhibits the immune inhibitory molecule may be one or more of an antibody or antibody fragment, an inhibitory nucleic acid, a clustered regularly interspaced short palindromic repeats (CRISPR), a transcription-activator like effector nuclease (TALEN), or a zinc finger endonuclease (ZFN) that inhibits the expression of the inhibitory molecule. In other embodiments of the methods or uses described herein, the agent that decreases the level or activity of the TREG cells is chosen from cyclophosphamide, antiGITR antibody, CD25-depletion, or a combination thereof. In certain embodiments of the methods or uses described herein, the immune inhibitory molecule is selected from the group consisting of PD1, PD-L1, CTLA-4, TIM-3, LAG-3, VISTA, BTLA, TIGIT, LAIR1, CD160, 2B4, TGFR beta, CEACAM-1, CEACAM-3, and CEACAM-5. In other embodiments, cytokine is chosen from IL2, IL-7, IL-15 or IL-21, or both. In other embodiments, the immune effector cell comprising the SIR molecule and a second, e.g., any of the combination therapies disclosed herein (e.g., the agent that that increases the efficacy of the immune effector cell) are administered substantially simultaneously or sequentially.

In other embodiments, the agent that inhibits the inhibitory molecule comprises a first polypeptide comprising an inhibitory molecule or a fragment thereof and a second polypeptide that provides a positive signal to the cell, and wherein the first and second polypeptides are expressed on the SIR-containing immune cells, wherein (i) the first polypeptide comprises PD1, PD-L1, CTLA-4, TIM-3, LAG3, VISTA, BTLA, TIGIT, LAIR1, CD160, 2B4, TGFR beta, CEACAM-1, CEACAM-3, and CEACAM-5 or a fragment thereof, and/or (ii) the second polypeptide comprises an intracellular signaling domain comprising a primary signaling domain and/or a costimulatory signaling domain. In one embodiment, the primary signaling domain comprises a functional domain of CD3 zeta; and/or the costimulatory signaling domain comprises a functional domain of a protein selected from 41BB, CD27 and CD28.

In one embodiment, lymphocyte infusion, for example allogeneic lymphocyte infusion, is used in the treatment of the cancer, infectious or immune diseases, wherein the lymphocyte infusion comprises at least one SIR-expressing cell of the disclosure. In one embodiment, autologous lymphocyte infusion is used in the treatment of the cancer, infectious or immune diseases, wherein the autologous lymphocyte infusion comprises at least one SIR-expressing cell described herein.

In one embodiment, the method includes administering a cell expressing the SIR molecule, as described herein, in combination with an agent which enhances the activity of a SIR-expressing cell, wherein the agent is a cytokine, e.g., IL-2, IL-7, IL-15, IL-21, or a combination thereof. The cytokine can be delivered in combination with, e.g., simultaneously or shortly after, administration of the SIR-expressing cell. Alternatively, the cytokine can be delivered after a prolonged period of time after administration of the SIR-expressing cell, e.g., after assessment of the subject's response to the SIR-expressing cell. In one embodiment the cytokine is administered to the subject simultaneously (e.g., administered on the same day) with or shortly after administration (e.g., administered 1 day, 2 days, 3 days, 4 days, 5 days, 6 days, or 7 days after administration) of the cell or population of cells. In other embodiments, the cytokine is administered to the subject after a prolonged period of time (e.g., at least 2 weeks, 3 weeks, 4 weeks, 6 weeks, 8 weeks, 10 weeks, or more) after administration of the cell or population of cells, or after assessment of the subject's response to the cell.

In other embodiments, the cells expressing a SIR molecule are administered in combination with an agent that ameliorates one or more side effects associated with administration of a cell expressing a SIR molecule. Side effects associated with the SIR-expressing cell can be chosen from cytokine release syndrome (CRS), hemophagocytic lymphohistiocytosis (HLH) or neurological complications. Examples of such agents include steroids (e.g. prednisone, dexamethasone), IL6R antagonists (e.g., tocilizumab), src kinase inhibitors (e.g., dasatinib), a kinase inhibitor (e.g., Ibrutinib), calcineurin inhibitors (e.g., tacrolimus or cyclosporine A) or chemotherapy drugs (e.g., cyclophosphamide, methotrexate or vincristine).

In embodiments of any of the aforesaid methods or uses, the cells expressing the SIR molecule are administered in combination with an agent that treats the disease associated with expression of the target antigen, e.g., any of the second or third therapies disclosed herein. Additional exemplary combinations include one or more of the following.

In another embodiment, the cell expressing the SIR molecule, e.g., as described herein, can be administered in combination with another agent that increases the expression of the target antigen against which the SIR is directed. For example, Classical Hodgkin's lymphoma, is characterized by the virtual lack of genes that are expressed MB-cells. Epigenetic repression of B-cell-specific genes via promoter hypermethylation and histone deacetylation and diminished expression of B-cell-committed transcription factors is reported to contribute to the lost B-cell phenotype in this disease. Du, J et al, identified several compounds (compounds 27, 40, 49) which promoted re-expression of the B-cell phenotype in classical Hodgkin lymphoma cells (Blood; Prepublished online Oct. 12, 2016). Anti-leukemia drugs arsenic trioxide and ATRA were also reported to promote re-expression of B cell phenotype in classical Hodgkin lymphoma when used alone or in combination with the identified compounds 27, 40 and 49. In one embodiment a cell expressing a SIR targeting B cell markers, such as CD19, CD20, CD22 etc, can be administered in combination with one or more of compounds 27, 40, 49, Arsenic trixoxide and ATRA.

In another embodiment, the SIR-expressing immune effector cell of the disclosure, e.g., T cell, NK cell or hematopoietic stem cell, is administered to a subject along with an agent that disrupt the immunosuppressive pathways in the tumor microenvironment in certain cancers. In one embodiment, the agent that disrupt the immunosuppressive pathways in the tumor microenvironment in cancers is an adenosine A2a receptor antagonist. An exemplary adenosine A2a receptor antagonist that can be administered along with SIR-expressing immune effector cells of the disclosure is Vipadenant.

In one embodiment, the SIR-expressing immune effector cell of the disclosure, e.g., T cell, NK cell or hematopoietic stem cell, is administered to a subject that has received a previous stem cell transplantation, e.g., autologous stem cell transplantation or an allogeneic stem cell transplantation.

In one embodiment, the SIR-expressing immune effector cell of the disclosure, e.g., T cell, NK cells or hematopoietic stem cells, is administered to a subject that has received a previous dose of chemotherapy, such as melphalan, fludarabine or cyclophosphamide.

In one embodiment, the SIR-expressing immune effector cell of the disclosure, e.g., T cell, NK cells or hematopoietic stem cells, is administered to a subject that has received a previous dose of a drug that enhances the expression of the target antigen of SIR, such as compounds 27, 40 and 49 (Du, J et al, Blood, Prepublished online Oct. 12, 2016) Arsenic trixoxide or ATRA.

In one embodiment, the cell expressing a SIR molecule, e.g., a SIR molecule described herein, is administered in combination with an agent that increases the efficacy of a cell expressing a SIR molecule, e.g., an agent described herein.

In one embodiment, the cells expressing a SIR molecule, e.g., a SIR molecule described herein, are administered in combination with a low, immune enhancing dose of an mTOR inhibitor. While not wishing to be bound by theory, it is believed that treatment with a low, immune enhancing, dose (e.g., a dose does not completely suppress the immune system but is sufficient to improve immune function) is accompanied by a reduction in PD-1 positive T cells or an increase in PD-1 negative cells. PD-1 positive T cells, but not PD-1 negative T cells, can be exhausted by engagement with cells which express a PD-1 ligand, e.g., PD-L1 or PD-L2.

Animal models can also be used to measure SIR activity. For example, xenograft model using human cancer associated antigen described herein-specific SIR+ T cells to treat a primary human pre-B-ALL in immunodeficient mice can be used. See, e.g., Milone et al., Molecular Therapy 17(S): 1453-1464 (2009). Very briefly, after establishment of ALL, mice are randomized as to treatment groups. Different numbers of a cancer associated antigen-specific SIR (e.g. CD19-SIR) engineered T cells are coinjected at a 1:1 ratio into NOD-SCID-$\gamma^{-/-}$ mice bearing B-ALL. The number of copies of a cancer associated antigen-specific SIR vector in spleen DNA from mice is evaluated at various times following T cell injection. Animals are assessed for leukemia at weekly intervals. Peripheral blood blast cell counts are measured in mice that are injected with B-ALL-SIR+ T cells or mock-transduced T cells. Survival curves for the groups are compared using the log-rank test. In addition, absolute peripheral blood CD4+ and CD8+ T cell counts 4 weeks following T cell injection in NOD-SCID-$\gamma^{-/-}$ mice can also be analyzed. Mice are injected with leukemic cells and 3 weeks later are injected with T cells engineered to express SIR by a bicistronic lentiviral vector that encodes the SIR linked to eGFP. T cells are normalized to 45-50% input GFP+ T cells by mixing with mock-transduced cells prior to injection, and confirmed by flow cytometry. Animals are assessed for leukemia at 1-week intervals. Survival curves for the SIR+ T cell groups are compared using the log-rank test.

Dose dependent SIR treatment response can be evaluated. See, e.g., Milone et al., Molecular Therapy 17(S): 1453-1464 (2009). For example, peripheral blood is obtained 35-70 days after establishing leukemia in mice injected on day 21 with SIR T cells, an equivalent number of mock-transduced T cells, or no T cells. Mice from each group are randomly bled for determination of peripheral blood B+ ALL blast counts and then killed on days 35 and 49. The remaining animals are evaluated on days 57 and 70.

Assessment of cell proliferation and cytokine production has been previously described, e.g., at Milone et al., Molecular Therapy 17(S): 1453-1464 (2009). Briefly, assessment of SIR-mediated proliferation is performed in microtiter plates by mixing washed T cells with K562 cells expressing a disease associated antigen described herein (K19) or CD32 and CD137 (KT32-BBL) for a final T-cell:K562 ratio of 2:1. K562 cells are irradiated with gamma-radiation prior to use. Anti-CD3 (clone OKT3) and anti-CD28 (clone 9.3) monoclonal antibodies are added to cultures with KT32-BBL cells to serve as a positive control for stimulating T-cell proliferation since these signals support long-term CD8+ T cell expansion ex vivo. T cells are enumerated in cultures using CountBright™ fluorescent beads (Invitrogen, Carlsbad, CA) and flow cytometry as described by the manufacturer. SIR+ T cells are identified by GFP expression using T cells that are engineered with eGFP-2A linked SIR-expressing lentiviral vectors. For SIR+ T cells not expressing GFP, the SIR+ T cells are detected with biotinylated recombinant a cancer associate antigen as described herein protein and a secondary avidin-PE conjugate. CD4+ and CD8+ expression on T cells are also simultaneously detected with specific monoclonal antibodies (BD Biosciences). Cytokine measurements are performed on supernatants collected 24 hours following re-stimulation using the human TH1/TH2 cytokine cytometric bead array kit (BD Biosciences, San Diego, CA) according the manufacturer's instructions. Fluorescence is assessed using a FACScalibur flow cytometer, and data is analyzed according to the manufacturer's instructions.

Cytotoxicity can be assessed by a standard $^{51}$Cr-release assay. See, e.g., Milone et al., Molecular Therapy 17(8): 1453-1464 (2009). Briefly, target cells (K562 lines and primary pro-B-ALL cells) are loaded with $^{51}$Cr (as NaCr04, New England Nuclear, Boston, MA) at 37° C. for 2 hours with frequent agitation, washed twice in complete RPMI and plated into microtiter plates. Effector T cells are mixed with target cells in the wells in complete RPMI at varying ratios of effector cell:target cell (E:T). Additional wells containing media only (spontaneous release, SR) or a 1% solution of triton-X 100 detergent (total release, TR) are also prepared. After 4 hours of incubation at 37° C., supernatant from each well is harvested. Released $^{51}$Cr is then measured using a gamma particle counter (Packard Instrument Co., Waltham, MA). Each condition is performed in at least triplicate, and the percentage of lysis is calculated using the formula: % Lysis=(ER−SR)/(TR−SR), where ER represents the average $^{51}$Cr released for each experimental condition. This or similar assays can be also used to detect the presence of SIR cells in any population. This assay can be also used to measure the expansion and persistence of SIR cells in any population.

Imaging technologies can be used to evaluate specific trafficking and proliferation of SIRs in tumor-bearing animal models. Such assays have been described, for example, in Barrett et al., Human Gene Therapy 22:1575-1586 (2011). Briefly, NOD/SCID/$\gamma^{-/-}$ (NSG) mice are injected IV with Nalm-6 cells followed 7 days later with T cells 4 hour after electroporation with the SIR encoding mRNA. The T cells are stably transfected with a lentiviral construct to express firefly luciferase, and mice are imaged for bioluminescence. Alternatively, therapeutic efficacy and specificity of a single injection of SIR+ T cells in Nalm-6 xenograft model can be measured as the following: NSG mice are injected with Nalm-6 transduced to stably express firefly luciferase, followed by a single tail-vein injection of T cells electroporated with a SIR (e.g., CD19-SIR; SEQ ID NO:1200) of the disclosure 7 days later. Animals are imaged at various time points post injection. For example, photon-density heat maps of firefly luciferase positive leukemia in representative mice at day 5 (2 days before treatment) and day 8 (24 hr post SIR+ PBLs) can be generated. A similar approach can be used to evaluate SIRs targeting other cancers or other diseases.

Other assays, including those described in the Example section herein as well as those that are known in the art can also be used to evaluate the SIRs described herein.

Pharmaceutical compositions of the disclosure may comprise a SIR expressing cell, e.g., a plurality of SIR-expressing cells, as described herein, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the disclosure are in one aspect formulated for intravenous administration. The composition may further comprise a secondary active agent (e.g., an anticancer, antiviral or antibiotic agent).

Pharmaceutical compositions of the disclosure may be administered in a manner appropriate to the disease to be treated (or prevented). The quantity and frequency of administration will be determined by such factors as the condition of the patient, and the type and severity of the patient's disease. When "an immunologically effective amount," "an anti-tumor effective amount," "a tumor-inhibiting effective amount," or "therapeutic amount" or "anti-infective" is indicated, the amount of the compositions of the disclosure to be administered can be determined by a physician with consideration of individual differences in age, weight, tumor size, extent of infection or metastasis, and condition of the patient (subject) as the case may be. It can generally be stated that a pharmaceutical composition comprising the immune effector cells (e.g., T cells, NK cells) described herein may be administered at a dosage of $10^4$ to $10^9$ cells/kg body weight, in some instances $10^5$ to $10^6$ cells/kg body weight, including all integer values within those ranges. T cell compositions may also be administered multiple times at these dosages. The cells can be administered by using infusion techniques that are commonly known in immunotherapy (see, e.g., Rosenberg et al., New Eng. J. of Med. 319:1676, 1988).

In certain aspects, it may be desired to administer activated immune effector cells (e.g., T cells, NK cells) to a subject and then subsequently redraw blood (or have an apheresis performed), activate immune effector cells (e.g., T cells, NK cells) therefrom according to the disclosure, and reinfuse the patient with these activated and expanded immune effector cells (e.g., T cells, NK cells). This process can be carried out multiple times every few weeks. In certain aspects, immune effector cells (e.g., T cells, NK cells) can be activated from blood draws of from 10 cc to 400 cc. In certain aspects, immune effector cells (e.g., T cells, NK cells) are activated from blood draws of 20 cc, 30 cc, 40 cc, 50 cc, 60 cc, 70 cc, 80 cc, 90 cc, or 100 cc.

In some embodiments, subjects may undergo leukapheresis, wherein leukocytes are collected, enriched, or depleted ex vivo to select and/or isolate the cells of interest, e.g., T cells. These T cell isolates may be expanded by methods known in the art and treated and/or transformed such that one or more SIR constructs of the disclosure may be introduced, thereby creating a SIR T cell of the disclosure. Subjects in need thereof may subsequently undergo standard treatment with high dose chemotherapy followed by peripheral blood stem cell transplantation. In certain aspects, following or concurrent with the transplant, subjects receive an infusion of the expanded SIR T cells of the disclosure. In an additional aspect, expanded cells are administered before or following surgery.

Kits to practice the disclosure are also provided. For example, kits for treating a cancer in a subject, or making a SIR T cell that expresses one or more of the SIRs disclosed herein. The kits may include a nucleic acid molecule or a polypeptide molecule encoding a SIR or a vector encoding a SIR along with a method to introduce the nucleic acid into the immune effector cells. The kit may include a virus comprising a nucleic acid encoding a SIR and chemicals, such as polybrene, to enhance the virus transduction. The kit may contain components for isolation of T cells for expressing a SIR. Alternatively, the kit may contain immune effector cells (e.g., T cells or NK cells) or stem cells expressing a SIR. More than one of the disclosed SIR can be included in the kit. The kit can include a container and a label or package insert on or associated with the container.

Suitable containers include, for example, bottles, vials, syringes, etc. The containers may be formed from a variety of materials such as glass or plastic. The container typically holds a composition including one or more of the nucleic acid molecules, viruses, vectors, T cells expressing a SIR. In several embodiments the container may have a sterile access port (for example the container may be an intravenous solution bag or a vial having a stopper pierceable by a hypodermic injection needle). A label or package insert indicates that the composition is used for treating the particular condition. The label or package insert typically will further include instructions for use of a disclosed nucleic acid molecules, SIRs or T cells expressing a SIR, for example, in a method of treating or preventing a tumor or of making a SIR T cell. The package insert typically includes instructions customarily included in commercial packages of therapeutic products that contain information about the indications, usage, dosage, administration, contraindications and/or warnings concerning the use of such therapeutic products. The instructional materials may be written, in an electronic form (such as a computer diskette or compact disk) or may be visual (such as video files). The kits may also include additional components to facilitate the particular application for which the kit is designed. Thus, for example, the kit may additionally contain means for measuring the expression of SIR on T cells or of determining the number or percentage of T cells that express the SIR or of determining the functionality of SIRT cells. The kits may additionally include buffers and other reagents routinely used for the practice of a particular method. Such kits and appropriate contents are well known to those of skill in the art.

The disclosure is further described by reference to the following experimental examples. These examples are provided for purposes of illustration only, and are not intended to be limiting unless otherwise specified. Thus, the disclosure should in no way be construed as being limited to the following examples, but rather, should be construed to encompass any and all variations which become evident as a result of the teaching provided herein.

EXAMPLES

The activity of a SIR can be tested by several in vitro and in vivo assays described herein and below. A general scheme for generating, selecting and using suitable SIRs is provided below:

Identification of target for SIR generation. A suitable target against which the SIR is designed is selected based on search of the literature or gene expression databases. In general, a suitable target for a SIR shows higher expression on the disease causing or disease associated cells as compared to normal healthy cells.

Generation of SIR. Once a candidate target antigen for SIR is identified, the antigen binding domain of SIR is designed based on information available in the literature. In general, the antigen binding domain of SIR is typically based on an antibody, an antibody fragments, scFV, or camelid vHH domains. The sequences of the variable chains of heavy (vH) and light (vL) chains of antibodies, the camelid vHH domains and various receptors and ligands can be obtained by sequencing or by publically available databases and can be used for synthesis of a SIR using the methods described herein as shown in different examples. The sequences comprising the antigen binding domains of SIR are codon optimized and synthesized artificially using publically available software (e.g. ThermoFisher or IDT) and commercial vendors (e.g. IDT). The resulting fragments are PCR amplified and cloned in different vectors containing the different SIR backbones using standard Molecular Biology techniques. In general SIR constructs are typically cloned in a lentiviral vector. The sequence of the SIR constructs are confirmed using automated sequencing.

An exemplary SIR construct is pLenti-EF1a-CD8SP-MYC3-WT1-Ab13-vL-V5-[hTCRb-KACIAH]-F-P2A-SP-WT1-Ab13-vH-Myc4-[hTCRa-CSDVP]-F-F2A-PAC-DWPRE [CLONE ID: 071516-J04](SEQ ID NO: 1380). This construct has many convenient restriction sites so that the antigen binding domain fragments (e.g., vL and vH domains) can be cut out and replaced with the antigen binding domain fragments targeting other antigens. For example, the vL domain can be cut out from the vector using EcoR I and Xho I restriction enzyme sites and replaced with a new DNA fragment containing EcoRI and XhoI sites and encoding a vL domain targeting another antigen. The vector carries an Nhe I site upstream of the CD8 Signal peptide (CD8SP), which can be also used along with the Xho I site to clone in a new vL fragment carrying a 5' signal peptide. The BstB I and Mlu I sites can be used to replace the vH fragment. The Xho I and Spe I sites can be used to replace the module encoding V5-[hTCRb-KACIAH]-F-P2A. Similarly, the MluI and Xba sites can be used to replace the module containing Myc4-[hTCRa-CSDVP]-F-F2A. The accessory module encoding PAC can be replaced using the Xba I (or Nde I) and SalI restriction sites. Thus, a person with ordinary skills in the art can use this vector and the sequence of the antigen binding domain (e.g., vL and vH domains of an antibody) to generate SIRs targeting any other new antigen.

Another exemplary construct that can be used to make SIR in which the antigen binding domain is connected to TCRb constant chain while the TCRa constant chain is left empty is pLenti-EF1a-CD8SP-MYC-[hTCRa-T48C-opt1]-F-F2A-FMC63-vH-V5-[hTCRb-S57C-opt1]-F-P2A-Pac-DWPRE [042616-B03] (SEQ ID NO 896). The antigen binding domain can be cloned between the BstB I and Mlu I restriction enzyme sites in this vector. Alternatively, an antigen binding domain with its own signal sequence can be cloned between Spe I and Mlu I restriction enzyme sites in this vector.

Another exemplary construct that can be used to make SIR in which the antigen binding domain is connected to TCRa constant chain while the TCRb constant chain is left empty is pLenti-EF1a-CD8SP-V5-[hTCRb-KACIAH]-F-P2A-FMC63-vH-MYC-[hTCRa-CSDVP]-F-F2A-Pac-DWPRE [081415-F04](SEQ ID NO 895). The antigen binding domain can be cloned between the BstB I and Mlu I restriction enzyme sites in this vector. Alternatively, an antigen binding domain with its own signal sequence can be cloned between Spe I and Mlu I restriction enzyme sites in this vector.

Generation of secretory antigen-NLuc fusion proteins. (Optional step). In order to test the expression and binding activity of SIR on immune effector cells, the extracellular domain of the antigenic target of SIR is fused via a short Gly-Ser linker to a luciferase, such as NLuc or GLuc or MLuc7 or TurboLuc16 or PaLuc. For example, the extracellular domain of CD19 is fused in frame to NLuc via a Gly-Ser-linker. The fusion protein carries an N-terminal Signal Sequence. The resulting construct is transiently transfected in 293FT cells and supernatant containing the secretory fusion protein collected after 48-72 hours.

Generation and use of secretory antigen binding domain (ABD)-NLuc fusion proteins. (Optional step). In order to identify suitable cell lines for testing the activity of a SIR, the antigen binding domain of a SIR is also fused via a short Gly-Ser linker to a luciferase, such as NLuc or GLuc or MLuc7 or TurboLuc16 or PaLuc. For example, in case a SIR is based on FMC63 monoclonal antibody targeting CD19, the scFV fragment (vL-Gly-Ser-linker-vH) of FMC63 is fused in frame to NLuc via a Gly-Ser-linker. The fusion protein carries an N-terminal Signal Sequence. The resulting construct is transiently transfected in 293FT cells and supernatant containing the secretory fusion protein collected after 48-72 hours. A panel of cell lines are tested for binding to the ABD-NLuc fusion protein to identify cell lines that express high level of SIR target and therefore can be used to test the activity of SIR. Table A provides an exemplary list of cell lines expressing different antigen targets that can be used to assay for the activity of a SIR of this disclosure. The cell lines expressing the target of SIR can be also identified using alternate methods such as literature search, immunostaining with commercially available antibodies or by searching publically available gene expression databases.

The Immune Effector Cells Expressing SIR are Tested in the Following Assays to Identify the Functional SIR.

(A) NLuc binding assay: The control vector- and SIR-expressing Jurkat-NFAT-GFP or T cells are stained with the target Antigen-Nluc fusion protein (as described above) and their ability to bind to the target antigen is assayed by measuring Nluc activity. For example, Jurkat-NFAT-GFP cells expressing FMC63 based SIR targeting CD19 show increased binding to CD19-NLuc fusion protein as compared to control vector expressing Jurkat-NFAT-GFP cells or parental Jurkat-NFAT-GFP cells.

(B) Induction of NFAT promoter driven GFP expression. The control vector- and SIR-expressing Jurkat-NFAT-GFP cocultured for 4-24 hours with the target antigen-expressing cell line (described above) and their ability to bind to the target antigen is assayed by measuring induction of GFP expression using Flow Cytometry. Cellular supernatant is collected and assayed for the induction of cytokines (e.g., IL2).

(C) Assay for cytokine production: The control vector- and SIR-expressing Jurkat-NFAT-GFP or T cells are cocultured with the target cell lines for 4-96 hours and supernatant examined for induction of cytokines (e.g., IL2, IFNγ, TNFα etc.) expression using ELISA.

(D) Assay for Cytotoxic Activity in vitro and in vivo: The uninfected T cells or those expressing a control vector or SIR are cocultured with the target cell lines expressing a non-secretory form of a luciferase (such as GLuc, NLuc, Turboluc 16 etc.) for 4-96 hours and induction of cell lysis examined by measuring the luciferase activity as described in PCT/US17/52344. Alternate methods for measurement of cytotoxic activity (e.g., $^{51}$Cr release assay or LDH release assay) can be used as well. The activity of T cells expressing a SIR can be also assayed in vivo using appropriate xenograft models in immunodeficient mice.

Based on the above methods, a person with ordinary skilled in the art can easily design, construct, test and select the appropriate functioning SIR or pool of SIRs against any antigen. The SIR or a pool of SIRs can be used for human clinical trials and clinical use for the prevention and treatment of various disease conditions. Table 9 provides an exemplary list of human disease conditions that can be treated using the SIRs of the disclosure.

It is possible that different SIRs or subset of SIRs are optimally suited for different disease conditions depending on various factors including, but not limited to, the prevalence and level of expression of the target antigen on disease causing and disease-associated cells, disease burden and rate of progression of the disease. Different SIRs may be optimally suited even for a single disease condition in different patients depending on their efficacy and toxicity profile and the condition of the patient. The disclosure provides a solution to the significant technical and logistical hurdles to generating a diverse adoptive immune response.

Normal TCR diversity is produced by gene rearrangement. Rigorous positive and negative selection processes in the thymus ensure that only T cells expressing the up TCR that are restricted to recognizing self-peptides/MHC within a low affinity range can populate the periphery. Thus, the thymic environment allows the generation of a pool of up T cells that are self-restricted, but not self-reactive.

Generating a diverse pool of SIRs from different antigen binding domains is limited by the technical and financial hurdles of generating and testing multiple antigen binding domains. More importantly, as each of the antigen binding domains (e.g., vL and vH fragments of an antibody) has a potential of binding other antigens and causing off-target toxicity, a diverse pool of SIRs based only on a plurality of antigen binding domains potentially has an increased risk of toxicity. Therefore, the potential diversity of such a pool would have to be limited to reduce off-target toxicity. The current disclosure overcomes this problem by generating a diverse pool of SIRs from a single or a few antigen binding domains by attaching them to different variants of TCR chains. The diversity of the SIR pool is further increased by the use of different linkers. The diversity of T cells expressing the pool can be further increased by use of different accessory modules and therapeutic controls described in the disclosure.

This diverse pool of SIRs can be used to provide a diverse immune response against disease causing or disease associated cells expressing the said antigen. Alternatively, the diverse pool of SIRs can be optionally DNA barcoded using techniques known the art and subsequently used to select a single or a subgroup of SIRs with optimal biological and clinical characteristics. These characteristics may include but are not limited to, performance in the in vitro biological assays (e.g., cytotoxicity, cytokine secretion, binding affinity, cell surface expression, off-target effects, T cell proliferation, expression of exhaustion markers and terminal differentiation etc.), performance in the in vivo assays (e.g., survival, tumor reduction, T cell persistence, T cell expansion etc.) and clinical experience (e.g., disease remission, relapse rate, toxicities, etc.). The SIRs of the disclosure can be used singly or in combination with other SIRs, CARs, cTCRs and other natural and synthetic immune receptors known in the art to generate a diverse pool of immune effector cells for the prevention and treatment of various disease conditions caused by or associated with cells expressing their target antigens.

The SIRs of the disclosure are modified forms of chimeric T cell receptors that have been optimized for not only diversity but also binding affinity, cell surface expression, chain pairing, signaling and cellular delivery. To generate a double chain SIR suitable for clinical applications, several technical and conceptual hurdles were addressed. A major limitation of the double chain cTCR platform is the technical difficulty of delivering two different plasmid constructs. Although it was possible to transduce a T cell with the two chains of the double chain SIR in two separate vectors, or in a single vector with two separate promoters, both these approaches risk imbalanced expression of the introduced SIR chains, increasing the possibility that a chain expressed in excess will mispair with endogenous TCR chains. An additional limitation of the two vector approach is the lower infection efficiency of the target cells as compared to the single vector approach. The use of two separate promoters in a single vector has a drawback of increasing the insert size, and hence the vector size, beyond the optimal packaging limit of most retroviral and lentiviral vectors, which in turn leads to reduced viral titers. Additionally, internal promoters can be silenced in retroviral vectors through promoter interference. Although the internal ribosome entry site (IRES) sequence of encephalomyocarditis virus has been widely used to construct bicistronic viral vectors, IRES-mediated translation is relatively inefficient. In addition, IRES are relatively large in size and the use of multiple IRES elements can lead to competition for translation factors and/or homologous recombination. With this in mind a 'self-cleaving' 2A peptide sequences derived from picornaviruses or porcine teschovirus were chosen for incorporation between the two SIR chains to achieve equimolar expression of both introduced SIR chains. Through a ribosomal skip mechanism, these sequences induce translation of two separate peptides from a single mRNA transcript, achieving near stoichiometric production of each peptide. Examples of cleavable "2A" peptides are provided in SEQ ID Nos: 3060-3062 and 3064. In some embodiments, an $(SG)_2$ motif was also added upstream of the 2A sequences to enhance the efficiency of cleavage. In addition, to avoid any remaining 2A peptide sequences linked to the SIR, a furine cleavage site was added upstream of the $(SG)_2$ motif to facilitate cleavage of the residual 2A peptide following translation.

Lentiviral and retroviral vectors were initially chosen to develop a double chain SIR system suitable for clinical applications. Subsequently experiments used sleeping beauty transposon and mRNA transfection to successfully express the SIRs in T cells.

The pLENTI-Blast vector was derived from pLenti6v5gw_lacz vector (Invitrogen; ThermoFisher Scientific) by removal of the LacZ gene. pLenti-MP2 was a gift from Pantelis Tsoulfas (Addgene plasmid #36097; Enomoto et al. Exp. Neurol. 248:170-82, 2013) and was used to generate the pLENTI-EF1α lentiviral vector (SEQ ID NO:870) by replacement of the CMV promoter with human EF1α promoter using standard molecular biology techniques. psPAX2 was a gift from Didier Trono (Addgene plasmid #12260). The pLP/VSVG envelope plasmid and 293FT cells were obtained from Invitrogen (ThermoFisher Scientific). The retroviral transfer vector MSCVneo, MSCVhygro, and MSCVpac and the packaging vector pKAT were obtained from Dr. Robert Illaria's laboratory. phRGTK Renilla Luciferase plasmid was from Promega.

Gene fragments encoding the different signal peptides, antibody binding domains, linkers, TCR constant chains, cleavable linkers and selection markers (e.g., PAC, EGFP, CNB30 etc.) were artificially synthesized in single or multiple fragments using a commercial supplier (IDT) and used as templates in PCR reactions with primers containing appropriate restriction enzymes. The amplified fragments were digested with appropriate restriction enzymes and then cloned in the pLENTI-EF1α (SEQ ID NO: 870), pLENTI-EF1α-DWPRE (SEQ ID NO: 871) or MSCV-Bgl2-AvrII-Bam-EcoR1-Xho-BstB1-Mlu-Sal-ClaI.I03 (SEQ ID NO: 872) vectors using standard molecular biology techniques. The pLENTI-EF1α-DWPRE vector differs from the pLENTI-EF1u in lacking the WPRE region. Alternatively, gene fragments encoding the entire SIR cassette (e.g. CD8signal-peptide-161-vL-TCRb-F-2A-IgH-signal peptide-161-vH-TCRa-F-2A-PAC) can be artificially synthesized. The resulting fragment can then be used as a template in PCR reaction with primers containing appropriate restriction enzymes. The amplified fragment can be digested with appropriate restriction enzymes and then cloned in the appropriate vector using standard molecular biology techniques.

A number of different lentiviral constructs were made containing the vL and vH fragments derived from FMC63 monoclonal antibody that were fused in frame to the constant regions of human TCR-beta (TCRb) and human TCR-alpha (TCRa) chains, respectively. Most of the constructs also carried different selection markers (e.g. puromycin N-acetyl-transferase (PAC), enhanced green fluorescent protein (EGFP) and secretory NLuc) fused to the SIR expression cassette through a linker encoding Furine-SGSG-2A.

An exemplary construct is CD8SP-FMC63-vL-V5-[hTCRb-WT]-F-P2A-SP-FMC63-vH-Myc-[hTCRa-WT]-F-F2A-PAC (080815-F02) [SEQ ID NO:922] cloned in pLenti-EF1a vector (SEQ ID NO:870). The SIR expression cassette in this vector is driven by human EF1α (elongation 1 alpha) promoter. The SIR expression cassette comprises from 5'-terminus-nucleotides encoding human CD8 signal peptide (CD8SP), a codon optimized FMC63 vL fragment, a V5 linker containing Gly-Ser-Gly amino acids at the C-terminal, constant region (C region) of human TCR-β2 (TCRb) chain, Furine cleavage site (RAKR), an SGSG linker, P2A ribosomal skip sequence, human IgH signal peptide, codon optimized FMC63 vH fragment, a Myc linker derived from the commonly used Myc epitope tag and containing Gly-Ser-Gly amino acids at the C-terminal, constant region (C region) of human TCR-α (TCRa) chain, a Furine cleavage site (RAKR), an SGSG linker, F2A ribosomal skip sequence and a variant form of puromycin resistance gene (PAC). There is an Xho I restriction enzyme site between the vL fragment and the V5 epitope tag, a Spe I restriction site before the human IgH signal peptide, an Mlu I site before the Myc tag, and a short linker containing Xba I and Nde I sites before the PAC gene. The whole expression cassette was cloned between the Nhe I and Sal I sites in the pLenti-EF1a vector (SEQ ID NO: 870). This vector can be used to clone the antigen binding domains targeting other antigens by removing the FMC63-vL and -vH fragments by digestion with Nhe I and XhoI and Spe I and Mlu I enzymes, respectively, and replacing them with DNA fragments encoding the antigen binding domains (e.g., vL, vH, vHH, scFv, receptors or ligands etc.) targeting other antigens using standard molecular biology techniques.

Several variants of the above constructs were created as well:

1. pLenti-EF1-FMC63vL-V5-[mTCRb-WT]-F-P2A-FMC63-vH-Myc-[mTCRa-WT]-F-F2A-Pac-B06: This construct resembles the pLenti-EF1-FMC63vL-V5-[hTCRb-WT]-F-P2A-FMC63-vH-Myc-[hTCRa-WT]-F-F2A-Pac-F02 construct except it has constant regions (C regions) of mouse TCR-β (TCRb) and mouse TCRα chains instead of the corresponding human chains.

2. pLenti-EF1-FMC63-vL-V5-[TCRb-S57C-opt1]-F-P2A-FMC63-vH-Myc-[TCR-ca-T48C-opt1]-F-F2A-PAC-L05 (050515-L05): This construct differed from pLenti-EF1-FMC63vL-V5-[hTCRb-WT]-F-P2A-FMC63-vH-Myc-[hTCRa-WT]-F-F2A-Pac-F02 in the following aspects:

a. The nucleotide sequences coding for constant regions of TCRb and TCRa chains were codon optimized to increase expression of the SIR.

b. To reduce the mispairing of the introduced TCR chains with endogenous TCR chains, an additional cysteine residue was added to each chain to promote the formation of an additional interchain disulfide bond. Thus, the TCRb sequence carried a Ser 57 to Cysteine mutation and the TCRa sequence carried a Threonine 48 to cysteine mutation.

3. pLenti-EF1-FMC63-vL-V5-[TCRb-KACIAH]-F-P2A-FMC63-vH-Myc-[TCRa-CSDVP]-F-F2A-PAC-D06 (081415-D06): This construct differed from pLenti-EF1-FMC63vL-V5-[hTCRb-WT]-F-P2A-FMC63-vH-Myc-[hTCRa-WT]-F-F2A-Pac-F02 in the following aspects:

a. The nucleotide sequences coding for constant regions of TCRb and TCRa chains were codon optimized to increase expression of the SIR.

b. To reduce the mispairing of the introduced TCR chains with endogenous TCR chains, an additional cysteine residue was added to each chain to promote the formation of an additional interchain disulfide bond. Thus, the TCRb sequence carried a Ser 57 to Cysteine mutation and the TCRa sequence carried a Threonine 48 to cysteine mutation.

c. Murine TCRs have been shown to express better than their human counterparts and murinization of human TCRs have been shown to improve their expression. In this construct, five amino acids of human TCRβ (TCRb) constant region were replaced by the corresponding murine amino acids. These murine amino acids were K-18, A-22, 1-133, A-136, and H-139. In addition, the region of murine TCRα (TCRa) constant chain containing the four amino acids Serine (S-91), aspartic acid (D-92), valine (V-93), and proline (P-94) were substituted in the human TCRα (TCRa) constant chain (SEQ ID NO: 3010).

In addition to lentiviral vectors, SIR expression cassettes were cloned into retroviral vector. For this purpose, pMSCV-puro retroviral vector was modified by digestion with Bgl II and Cla I enzymes and ligation of a BglII and ClaI cut double stranded oligonucleotide containing restriction enzyme sites for AvrII, BamHI, EcoRI, XhoI, BstBI, MluI and SalI. The sequence of the resulting vector named MSCV-Bgl2-AvrII-Bam-EcoR1-Xho-BstBI-Mlu-Sal-ClaI.I03 in SEQ ID NO: 872. The expression cassette for different SIR constructs were digested from pLenti-EF1 vectors using NheI and SalI enzymes and cloned in the above vector that had been digested with AvrII and SalI. The sequence of an exemplary SIR Construct MSCV-FMC63vL-V5-[TCRb-KACIAH]-F-P2A-2-Spe-FMC63vH-MYC-[TCRa-CSDVP]-F-F2A-Pac.N01 [CLONE ID: 032216-N01] is presented in SEQ ID NO: 873. Other SIR constructs in MSCV based retroviral vectors can be easily constructed by cloning the NheI to SalI fragments from their corresponding pLenti-EF1 vectors.

SIR expression cassettes were also cloned into sleeping beauty vectors pSBbi-pur (SEQ ID NO: 874; Addgene; Plasmid #60523) and pSBbi-GP (Addgene; Plasmid #60511). For this purpose, the expression cassettes for different SIR constructs were digested from pLenti-EF1 vectors using AgeI and XbaI enzymes and cloned in the pSBbi-pur and pSBbi-GP vector that had been digested with AgeI and XbaI enzymes. The sequence of an exemplary vector encoding a SIR targeting CD19 is provided in SEQ ID NO: 875. The sequence of another exemplary sleeping beauty vector with an extended multicloning site is presented in SEQ ID NO: 876.

Cell lines engineered to express luciferases (e.g., GLuc or NLuc) for measuring cytotoxicity of different constructs targeting different cell surface and intracellular antigens are provided in Table A. Cell lines used in this experiments, target antigens on the cells lines and their growth media are shown in the following Table A. Cells were cultured at 37° C., in a 500 CO2 humidified incubator. The cell lines were obtained from ATCC, NIH AIDS reagent program or were available in the laboratory.

TABLE A

| Cell line | Culture Conditions | Exemplary SIR Target Antigens Expressed |
|---|---|---|
| BC-1 | RPMI, 20% FCS | BCMA, GPRC, CD138 |
| BC-3 | RPMI, 20% FCS | BCMA, GPRC, CD138 |
| BCBL-1 | RPMI, 20% FCS | GPRC, CD138 |
| JSC-1 | RPMI, 20% FCS | GPRC, CD138 |
| MM1S | RPMI, 10% FCS | CD38, GPRC, CD44, CD200R |
| U266 | RPMI, 10% FCS | BCMA, WT1/HLA-A2+, CS1, CLL1, CD138, c-MET, IL6R, CD179b, NY-ESO/HLA-A2, NYBR, LAMP1 |
| L363 | RPMI, 10% FCS | BCMA, GPRC, WT1/HLA-A2+, CS1, CLL1, CD138, NY-ESO/HLA-A2, NYBR, LAMP1 |
| K562 | RPMI, 10% FCS | CD33, IL1Ra, TnAg |
| BV173 | RPMI, 10% FCS | CD123, CD179b, IL1Ra, WT1/HLA-A2+, CXCR4, FLT3, CD179a |
| Nalm6 | RPMI, 10% FCS | CD19, CD20, CD22, CD179b, CD179a |
| HL60 | RPMI, 10% FCS | CD33, CD34, CLL1, IL6R, CD32, CD179 |
| U937 | RPMI, 10% FCS | CD4, CLL1 |
| RS: 411 | RPMI, 20% FCS | CD19, Folate Receptor beta (FRbeta), TGFbeta, CD179b, NKG2DNKG2D, FLT3, CD179a |
| MV: 411 | RPMI, 10% FCS | FLT3, CD123, FRbeta |
| Raji | RPMI, 10% FCS | CD19, CD20, CD22, BCMA, CD38, CD70, CD79, Folate Receptor beta, CLL1 |
| HEL-92.1.7 (HEL) | RPMI, 10% FCS | MPL, CD33, CD32, CD200R |
| Jurkat | RPMI, 10% FCS | TnAg, TSLRP, TSHR, CD4, CD38 |
| Daudi | RPMI, 10% FCS | BCMA, FRbeta |
| REC-1 | RPMI, 10% FCS | NKG2DNKG2D, ROR1 |
| KG-1 | RPMI, 20% FCS | CD33, CD34, CD123, TSLRP |
| CEM | RPMI, 10% FCS | CD5, CD43 |
| U937 | RPMI, 10% FCS | CD4, CLL1 |
| LAMA5 | RPMI, 10% FCS | WT1/HLA-A2 |
| A549 | DMEM, 10% FCS | ROR1, CD22, TIM1, CDH17 |
| HT29 | DMEM, 10% FCS | EGFR, SLEA, c-MET |
| Molm-13 | RPMI, 20% FCS | FLT3, IL6R, LAMP1, TSLRP, CD4, CSF2RA, CXCR4, IL6R, CSF2RA, GPC3 |
| A431 | DMEM, 10% FCS | EGFR, Folate Receptor Alpha, Her3 |
| P19 | DMEM, 10% FCS | SSEA |
| THP-1 | RPMI, 10% FCS | CD32, CD33, CXCR4, CD123, CD44, IL6R, Folate Receptor beta, CD70, LAMP1, FLT3, CSF2RA |
| U87MG | DMEM, 10% FCS | CD276, gpNMB, IL13RA2 |
| LoVo | DMEM, 10% FCS | Tissue Factor, CDH17, EGFR |
| SKOV-3 | DMEM, 10% FCS | Folate Receptor alpha (FR1), FSHR, Her2, Her3, LHR, MSLN, TIM1, EPCAM |
| NCI-H1993 | DMEM, 10% FCS | EGFR |
| Kasumi-1 | RPMI, 20% FCS | CLEC5A, PR1/HLA-A2, TGFbeta, |
| Jeko-1 | RPMI, 20% FCS | BCMA, ROR1 |
| PC-3 | DMEM, 10% FCS | CGH, TROP2, PSCA, PSMA. EPCAM, FSHR, CLD18A2 (CLDN18.2) |
| HeLa | DMEM, 10% FCS | EGFR, FR1, MSLN, TSHR |
| LnCap | DMEM, 10% FCS | EGFR, FSHR, PSCA, PSMA, CD22, Her3, CD22, LHR, CLD18A2 (CLDN18.2) |
| OVCAR-3 | DMEM, 10% FCS | B7H4, CDH6, DLL3, FR1, FSH, LHR, MSLN, PTK7, TnAg, TSHR, L1CAM |
| MEL-624 | DMEM, 10% FCS | CDH19, GD2, GD3, gp100/HLA-A2, gpNMB, HMWMAA, NYESO/HLA-A2, MART1/HLA-A2 |
| LS174-T | DMEM, 10% FCS | CEA |
| MEL-526 | DMEM, 10% FCS | GD2 |
| MDA-MB231 | DMEM, 10% FCS | CD324, Muc1 |

TABLE A-continued

| Cell line | Culture Conditions | Exemplary SIR Target Antigens Expressed |
|---|---|---|
| L1236 | RPMI, 20% FCS | CD30, CD23, PDL1 |
| L428 | RPMI, 20% FCS | CD30, CD123, CCR4, PDL1 |
| L540 | RPMI, 20% FCS | CD30, CCR4, PDL1 |
| Molt-16 | RPMI, 20% FCS | IL1ra, NKG2DNKG2D |
| CEM | RPMI, 10% FCS | CD5 |
| MG-63 | DMEM, 10% FCS | IL13RA2 |
| Karpass-299 | RPMI, 20% FCS | Alk, GPRC, PDL1 |
| MCF7 | DMEM, 10% FCS | B7D4, CD276, TROP2, Her3, Muc1, LewisY, LHR |
| AA-2 | RPMI, 10% FCS | HIV1 env glycoprotein (gp120) |
| HL2/3 | DMEM, 10% FCS | HIV1 env glycoprotein (gp120) |
| TF228.1.16 | DMEM, 10% FCS | HIV1 env glycoprotein (gp120), CCR4 |
| TT | DMEM, 10% FCS | TGF-Beta, TSHR, GFRalpha4 |
| DMS7 9 | RPMI, 10% FCS | Fucosyl-GM1, Slea (CA19.9; Sialyl Lewis Antigen) |
| LAN-5 | DMEM, 10% FCS | ALK, DLL3, GFRalpha4, FUCOSYL-GM1 |
| PEER1 | RPMI, 10% FCS | TSHR |
| SK-MEL-37 | DMEM, 10% FCS | DLL3, GD2 |
| F9 | DMEM, 10% FCS | SSEA |
| HepG2 | DMEM, 10% FBS | GPC3, AFP/HLA-A2 |

Jurkat cell line (clone E6-1) engineered with a NFAT-dependent GFP reporter gene was a gift from Dr. Arthur Weiss at UCSF. Jurkat cells were maintained in RPMI-1640 medium supplemented with 1000 FBS, penicillin and streptomycin.

Generation of Lentiviruses and retroviruses. Lentiviruses were generated by calcium phosphate based transfection in 293FT cells essentially as described previously (Matta, Hozayev, Tomar, Chugh, & Chaudhary, 2003). 293FT cells were grown in DMEM with 10% FCS 4 mM L-Glutamine, 0.1 mM MEM Non-Essential Amino Acids, and 1 mM MEM Sodium Pyruvate (hereby referred to as DMEM-10). For generation of lentivirus, 293FT cells were plated in 10 ml of DMEM-10 medium without antibiotics in a 10 cm tissue culture plate so that they will be approximately 80 confluent on the day of transfection. The following day, the cells were transfected by calcium phosphate transfection method using 10 µg of lentiviral expression plasmid encoding different genes, 7.5 µg of PSPAX2 plasmid and 2 µg of PLP/VSVG plasmid. Approximately 15-16 hours post-transfection, 9 ml of media was removed and replaced with 5 ml of fresh media. Approximately, 48 hours post-transfection, 5 ml of supernatant was collected (first collection) and replaced with fresh 5 ml media. Approximately 72 hrs post-transfection, all media was collected (second collection, usually around 6 ml). The collected supernatants were pooled and centrifuged at 1000 rpm for 1 minute to remove any cell debris and non-adherent cells. The cell-free supernatant was filtered through 0.45 µm syringe filter. In some cases, the supernatant was further concentrated by ultracentrifugation at 18500 rpm for 2 hours at 4° C. The viral pellet was re-suspended in 1/10 of the initial volume in XVIVO medium. The virus was either used fresh to infect the target cells or stored frozen in aliquots at −80° C.

Infection of T cells and PBMC. Buffy coat cells were obtained from healthy de-identified adult donors from the Blood Bank at Children Hospital of Los Angeles and used to isolate peripheral blood mononuclear cells (PBMC) by Ficoll-Hypaque gradient centrifugation. PBMC were either used as such or used to isolate T cells using CD3 magnetic microbeads (Miltenyi Biotech) and following the manufacturer's instructions. PBMC or isolated T cells were re-suspended in XVIVO medium (Lonza) suplanted with 10 ng/ml CD3 antibody, 10 ng/ml CD28 antibody and 100 IU recombinant human-IL2. Cells were cultured at 37° C., in a 5% Cβ2 humidified incubator. Cells were activated in the above medium for 1 day prior to infection with lentiviral vectors. In general, primary cells (e.g. T cells) were infected in the morning using spin-infection (1800 rpm for 90 minutes at 37° C. with 300 µl of concentrated virus that had been re-suspended in XVIVO medium in the presence of 8 µg/ml of Polybrene® (Sigma, Catalog no. H9268). The media was changed in the evening and the infection was repeated for two more days for a total of 3 infections. After the 3$^{rd}$ infection, the cells were pelleted and resuspended in fresh XVIVO media containing 10 ng/ml CD3 antibody, 10 ng/ml CD28 antibody and 100 IU recombinant human-IL2 and supplemented with respective antibiotics (if indicated) and place in the cell culture flask for selection, unless indicated otherwise. Cells were cultured in the above medium for 10-15 days in case no drug selection was used and for 20-30 days in case drug-selection was used. In cases, where cells were infected with a lentivirus expressing EGFP, they were expanded without drug-selection or flow-sorted to enrich for EGFP-expressing cells. For infection of cancer cell lines, approximately 500,000 cells were infected with 2 ml of the un-concentrated viral supernatant in a total volume of 3 ml with Polybrene® (Sigma, Catalog no. H9268). Then next morning, the cells were pelleted and resuspended in the media with respective antibiotics and place in the cell culture flask for selection.

Essentially a similar procedure as described above for lentivirus vector production was used for generation of retroviral vectors with the exception that 293FT cells were generally transfected in 10 cm tissue culture plates in 10 ml of DMEM-10 medium using 10 µg of retroviral construct, 4 µg of pKAT and 2 µg of VSVG plasmid. The virus collection and infection of target cells was carried out essentially as described above for lentiviral vectors.

Jurkat cell electroporation with Sleeping Beauty Vectors. For electroporation, 5×10$^6$ Jurkat cells were centrifuged at 90 g for 10 minutes, resuspended in 100 µL of buffer and mixed with 20 µg of sleeping beauty SIR encoding plasmid and 5 µg of SB100X transposase plasmid. The electroporation buffer and cuvettes were provided with Amaxa Cell Line Nucleofector Kit V (VCA-1003) from Lonza. The resuspended cells were transferred to cuvettes and electroporated using the program X-001. After electroporation, cells were incubated in the cuvette at room temperature for 10 minutes and then 1 ml of pre-warmed RPMI medium supplemented with 20% FBS were added to the cells in the cuvette. Cells were transferred to a 6-well plate containing 1 ml pre-warmed medium in each well and incubated at 37° C. overnight. Next day, cells were centrifuged and medium was replaced by RPMI supplemented with 10% FBS and 250 ng/ml puromycin to select sleeping beauty-SIR expressing Jurkat cells.

Antibodies and drug. Digitonin was purchased from Sigma (Cat. no D141) and a stock solution of 100 mg/ml was made in DMSO. A diluted stock of 1 mg/ml was made in PBS. Final concentration of digitonin used for cell lysis was 30 µg/ml unless indicated otherwise.

IL2 ELISA. Human IL2 was measured in the cell culture supernatant of SIR-expressing Jurkat-NFAT-GFP effector cells or T cells that had been co-cultured with the specific target cell lines for 24 to 96 hours using IL2-ELISA kit from R&D systems (Minneapolis, MN) and following the recommendations of the manufacturer.

FACS analysis. Mouse Anti-Human c-Myc APC-conjugated Monoclonal Antibody (Catalog #IC3696A) was from R&D Systems (Minneapolis, MN). Biotinylated protein L was purchased from GeneScript (Piscataway, NJ), reconstituted in phosphate buffered saline (PBS) at 1 mg/ml and stored at 4° C. Streptavidin-APC (SA1005) was purchased from ThermoFisher Scientific.

For detection of CARs and SIRs using Myc staining, $1 \times 10^6$ cells were harvested and washed three times with 3 ml of ice-cold 1×PBS containing 4% bovine serum albumin (BSA) wash buffer. After wash, cells were resuspended in 0.1 ml of the ice-cold wash buffer containing 10 µl of APC-conjugated Myc antibody and incubated in dark for 1 hour followed by two washings with ice cold wash buffer.

For detection of CARs and SIRs using Protein L staining, $1 \times 10^6$ cells were harvested and washed three times with 3 ml of ice-cold 1×PBS containing 4% bovine serum albumin (BSA) wash buffer. After wash, cells were resuspended in 0.1 ml of the ice-cold wash buffer containing 1 µg of protein L at 4° C. for 1 hour. Cells were washed three times with ice-cold wash buffer, and then incubated (in the dark) with 10 µl of APC-conjugated streptavidin in 0.1 ml of the wash buffer for 30 minutes followed by two washings with ice cold wash buffer. FACS was done using FACSVerse analyzer from BD Biosciences.

Cell death assay. To measure cell death, a novel assay based on ectopic cytosolic expression of Gluc or NLuc was utilized as described in PCT/US17/52344 "A Non-Radioactive Cytotoxicity Assay". The method involves expression of a reporter in a target cells in a manner so that it is preferentially retained within the healthy cells but is either released from dead and dying cells or whose activity can be preferentially measured in dead and dying cells. The preferred reporter for this assay are 1) non-secreted forms of luciferases from the copepods, such as *Gaussia princeps*, *Pleuromamma abdominalis*, *Metridia pacifica*, *Metridia curticauda*, *Metridia asymmetrica*, *Metridia okhotensis*, *Metridia longa*, *Lucicutia ovaliformis*, *Heterorhabdus tanneri*, and *Pleuromamma scutullata* 2) engineered luciferase reporters from deep sea shrimp, such as NanoLuc. The sequence of several such reporter vectors is provided in SEQ ID NO: 881 to SEQ ID NO: 887. The above vectors were used to generate retrovirus and lentiviruses which in turn were used to generate polyclonal population of several target cell lines stably expressing GLuc, NLuc, TurboLuc or MLuc7 following selection with appropriate antibiotics. Unless indicated otherwise, the target cells stably expressing the different luciferases (GLuc, Nluc, MLuc7 or TurboLuc16) were plated in triplicate in a 384 well plate in the media used for growing the target cells. Target cells which grow in suspension were generally plated at a concentration of $2-3 \times 10^4$ per well, while target cells which grow as adherent monolayers were plated at a concentration of $1-2 \times 10^4$ per well. Unless indicated otherwise, the target cells were cocultured with the genetically modified T cells (i.e. those expressing SIR or CAR) at an Effector:Target (E:T) ratio varying from 1:1 to 10:1 for 4 hours to 96 hours. In the case target cells grow as adherent cells (e.g., HeLa cells), they were allowed to attach to the bottom of the wells overnight before the T cells were added. T cells mediated induction of lysis of target cells was assayed by increase of luciferase activity as measured by BioTek synergy plate reader by directly injecting 0.5×CTZ assay buffer containing native coeloentrazine (Nanaolight).

CTZ assay. A 100× stock solution of native coelenterazine (CTZ; Nanolight, cat #303) was made by dissolving 1 mg of lyophilized CT powder in 1.1 ml of 100% Methanol supplemented with 30 µl of 6N HCl to avoid oxidation of CTZ with time. To make CTZ assay buffer, the 100× stock solution of CTZ was diluted to 0.5× concentration in PBS. Unless indicated otherwise, a total volume of 15 µl of the CTZ assay buffer (as prepared above) was added to each well of a 384-well white plate (Greiner, 384 well white plate cat #781075) containing cells expressing the non-secretory form of the luciferase in approximately 50-60 µl volume of medium and plates were read for luminescence in endpoint mode using BioTek synergyH4 plate reader. For 96 well plates, cells were plated in 200 µl of media and approximately 50 µl of 0.5×CTZ assay buffer was added. Unless indicated otherwise, the 0.5×CTZ assay buffer was used for assaying the activity of GLuc, TurboLuc16, and MLuc7. The CTZ assay buffer (diluted to 0.125× concentration) was also used for measurement of NLuc activity in some experiments (see below). In general, unless indicated otherwise, the volume of 0.5×CTZ assay buffer added was approximately $\frac{1}{4}^{th}$ of the volume of the liquid in the well containing the cells, although the assay also worked when the 0.5×CTZ assay was added to the media containing the cells in 1:1 volume. Gluc activity in wells containing media alone (Med) and in wells in which target cells were incubated with T cells that were not infected with any SIR construct (T-UI) were used as controls where indicated.

Plates were read for luminescence in endpoint mode using BioTek synergyH4 plate reader without prior cell lysis. In some experiments, NLuc activity was measured using CTZ assay buffer but here the buffer was diluted to final concentration of 0.125×. When CTZ assay buffer was used for measurement of NLuc activity, a total volume of approximately 15 µl (unless indicated otherwise) of the 0.125×CTZ assay buffer was added by injector to each well of a 384-well white plate (Greiner, 384 well white plate cat #781075) containing cells in approximately 50-60 µl volume of medium and plates were read for luminescence in endpoint mode using BioTek synergyH4 plate reader. For 96 well plates, cells were generally plated in 200 µl of media and approximately 50 µl of 0.125×CTZ assay buffer was added.

Development of an Assay to detect the expression of CD19 and MPL (Thrombopoietin receptor) antigens. To detect the expression of SIR and their target antigens, a luciferase based reporter assay was utilized as described in PCT/US2017/025602 "A Highly Sensitive And Specific Luciferase Based Reporter Assay For Antigen Detection". Both CD19 and MPL (also known as Thrombopoietin receptor or TPO-R) are expressed on hematopoietic cells but show differential expression in cells of different lineages. FMC63 is a well characterized mouse monoclonal antibody that specifically recognizes human CD19. Similarly, 161 is a monoclonal antibody that recognizes human MPL. We generated a FMC63 single chain Fv (scFv) fragment based on the known sequence of FMC63 vL and vH fragments. The cDNA encoding FMC63 scFv fragment consisted from 5' to 3' ends a nucleotide sequences encoding a signal peptide derived from human CD8 molecule, FMC63 vL fragment, a (Gly4Ser)×3 linker and FMC63-vH fragment. The cDNA encoding the FMC63 scFv fragment was then fused in-frame at its 3' end to cDNA encoding AcV5-tagged NLuc through a Gly-Gly-Ser-Gly linker to generate FMC63-GGSG-NLuc, which was then cloned downstream of the human EF1α promoter into the lentiviral vector pLenti-EF1 to make the construct Plenti-EF1a-FMC63(vL-vH)-GGSG-NLuc-AcV5-U09 (SEQ ID NO: 880). The sequence of the insert fragment is provided in SEQ ID NO: 4516. A construct encoding 161-GGSG-NLuc was similarly generated using the vL and vH fragment of 161 monoclonal antibody against MPL. The nucleic acid sequence of the insert fragment is provided in SEQ ID NO: 4517. The pLenti-EF1-FMC63-GGSG-NLuc-AcV5 and pLenti-EF1-161-GGSG-NLuc-AcV5 plasmids were transfected into 293FT cells by calcium phosphate co-precipitation method. Approximately 20 h post-transfection, the cell culture media was replaced with XVIVO medium. The conditioned media containing the secreted FMC63-GGSG-NLuc-AcV5 and 161-GGSG-NLuc-AcV5 proteins was collected 48-72 h later.

The supernatant containing FMC63-GGSG-NLuc-AcV5 and 161-GGSG-NLuc-AcV5 proteins were used to detect the expression of CD19 and MPL on the surface of Jurkat, K562, RAJI, RS-4-11 (RS411) and HEL.92.1.7 (HEL) cells that had been engineered to express a c-MPL cDNA by transducing these cells with a lentiviral vector expressing human c-MPL cDNA or an empty vector. The cells also expressed a humanized Gluc cDNA lacking its signal peptide. The vector- and MPL-expressing Jurkat-Gluc, K562-Gluc, HEL.92.1.7-Gluc, RAJI-Gluc and RS411-Gluc cells were incubated with the FMC63-GGSG-NLuc-AcV5 and 161-GGSG-NLuc-AcV5 supernatants at 4° C. for 1h followed by extensive washings with cold PBS supplemented with 0.1% BSA. The cells were re-suspended in cold PBS and 30 µl of cell suspension was plated per well in a flat-bottom 384 well plate (Greiner, 384 well white plate cat. #781075) in triplicate. NLuc assay buffer containing native coelenterazine (CTZ) as NLuc substrate (30 µl/well of native coelenterazine diluted in PBS) was added to each well by an automatic dispenser in a well mode using a BioTek synergy H4 plate reader and light emission as a measure of NLuc activity was measured. Strong binding was observed with 161-GGSG-NLuc-AcV5 was observed on HEL.92.1.7-Gluc-vector cells suggesting significant expression of MPL endogenously. Ectopic expression of MPL in HEL.92.1.7-Gluc-MPL cells led to a modest increase in 161-GGSG-NLuc-AcV5 binding. In contrast, very weak binding with 161-GGSG-NLuc-AcV5 was observed on vector-expressing Jurkat, RAJI and RS411 cells and was only modestly increased upon ectopic expression of MPL. Binding of 161-GGSG-NLuc-AcV5 was observed on K562-vector cells, and was significantly increased on K562-MPL cells. In contrast to 161-GGSG-NLuc-AcV5, the FMC63-GGSG-NLuc-AcV5 supernatant showed strongest binding on vector- and MPL-expressing RAJI cells, modestly strong binding on RS411 cells and very weak to negligible binding on the other cells.

Development of an Assay for quantitative measurement of the binding affinity of chimeric antigen receptors (CAR) and chimeric TCR (SIR) targeting CD19 and MPL (Thrombopoietin receptor) to their receptors. A frequent problem in the field of adoptive cellular therapy is lack of a sensitive and specific assay that can detect cells that express chimeric antigen receptors and SIRs. Although staining with Protein-L can be used to detect the cell surface expression of scFv containing CARs and SIRs, it fails to measure the interaction of CARs and SIRs with their target antigen. To detect the binding affinity of CAR targeting CD19 and MPL, highly sensitive luciferase reporter based antigen detection assay, as described in PCT/US2017/025602, was used which is incorporated in its entirety by reference. The extracellular domains of human CD19 and human MPL, including their signal peptides, were fused in frame with nucleotide sequence encoding a Gly-Gly-Ser-Gly linker, NLuc (without a secretory signal) and an AcV5 epitope tag. In the case of CD19 construct, a FLAG tag was inserted between the signal peptide and the beginning of the extracellular domain. The whole cassette was cloned downstream of the human EF1α promoter into the lentiviral vector pLenti-EF1 to make constructs pLenti-EF1-CD19-GGSG-NLuc-AcV5 and pLenti-EF1-MPL-GGSG-NLuc-AcV5, respectively. The nucleic acid sequences of the insert fragments are provided in SEQ ID NO: 4518 and 4519, respectively. The constructs were transfected into 293FT cells by calcium phosphate co-precipitation method. Approximately 20 h post-transfection, the cell culture media was replaced with fresh medium. The conditioned media containing the secreted Flag-CD19-GGSG-NLuc-AcV5 and MPL-GGSG-NLuc-AcV5 proteins was collected 48-72 h later.

293FT-cells were transiently transfected (in a 24-well plate, 500 ul volume) with lentiviral constructs expressing chimeric antigen receptors targeting CD19 (FMC63-BBZ-PAC; SEQ ID NO: 4501), MPL (161-BBZ-PAC-R07; SEQ ID NO: 4502 or 161-28Z-PAC-Z07) using calcium phosphate cotransfection method or left untransfected. Next day morning, approximately 18 hours post-transfection, cells were collected by pipetting up and down in 1.5 ml tubes. The tubes were spun down at 1500 RPM for 5 minutes. Then the cells were washed once with wash buffer (1% FBS in PBS), followed by incubation with 100 µl of indicated secretory forms of GGS NLuc supernatant. The cells were incubated at 4° C. for 1 hour.

After the incubation, cells were washed 5 times with wash buffer (1 ml each wash). Finally the pellet was resuspended in 200 µl wash buffer. Resuspended cells were placed in a 384 well plate in triplicate (25 µl each). Luciferase activity was measured using a BioTek synergy H4 plate reader after addition of NLuc assay buffer (Promega) containing native coelenterazine (25 µl each well) directly to each well (one at a time).

Figure 9A:
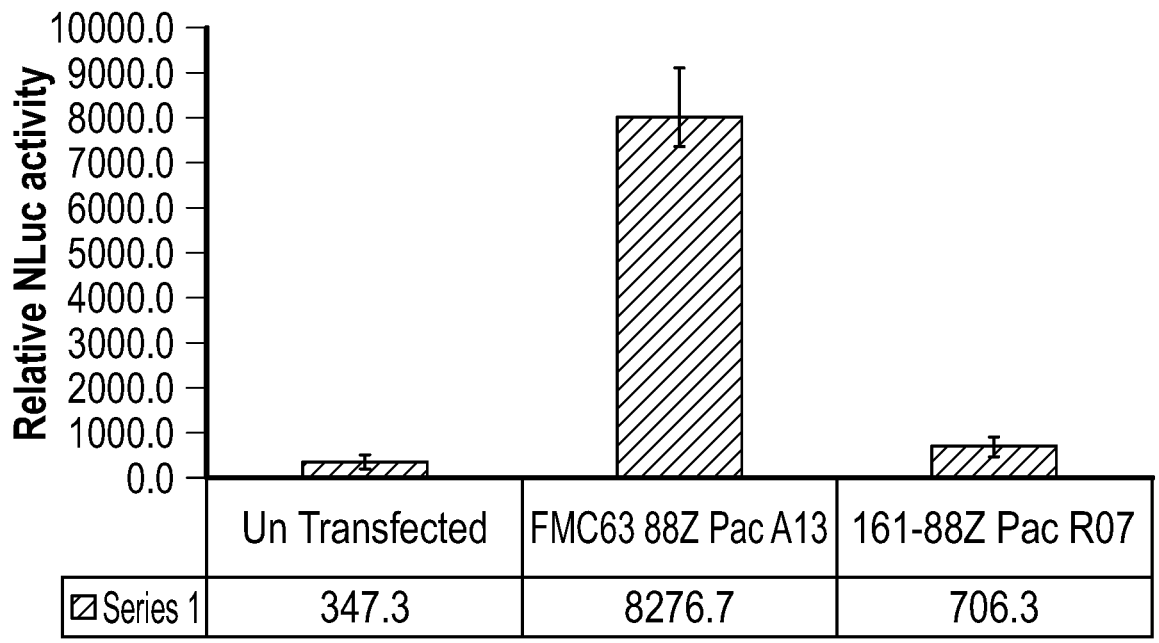
FIG. 9A-B shows NLuc assay to measure expression of CAR in 293FT cells. The untransfected 293FT cells, and those transfected with CD19 (FMC63-BBZ-PAC) and 161-BBZ-PAC CAR were incubated with CD19-GGSG-NLuc-AcV5 and MPL-GGSG-NLuc-AcV5 supernatants followed by washing with PBS and measurement of NLuc activity by Coeleoentrazine (CTZ; Nanolight) diluted in PBS. Luminescence was quantified using a BioTek plate reader. Data represents mean values of triplicate wells+/−standard deviation (SD).
Figure 9B:
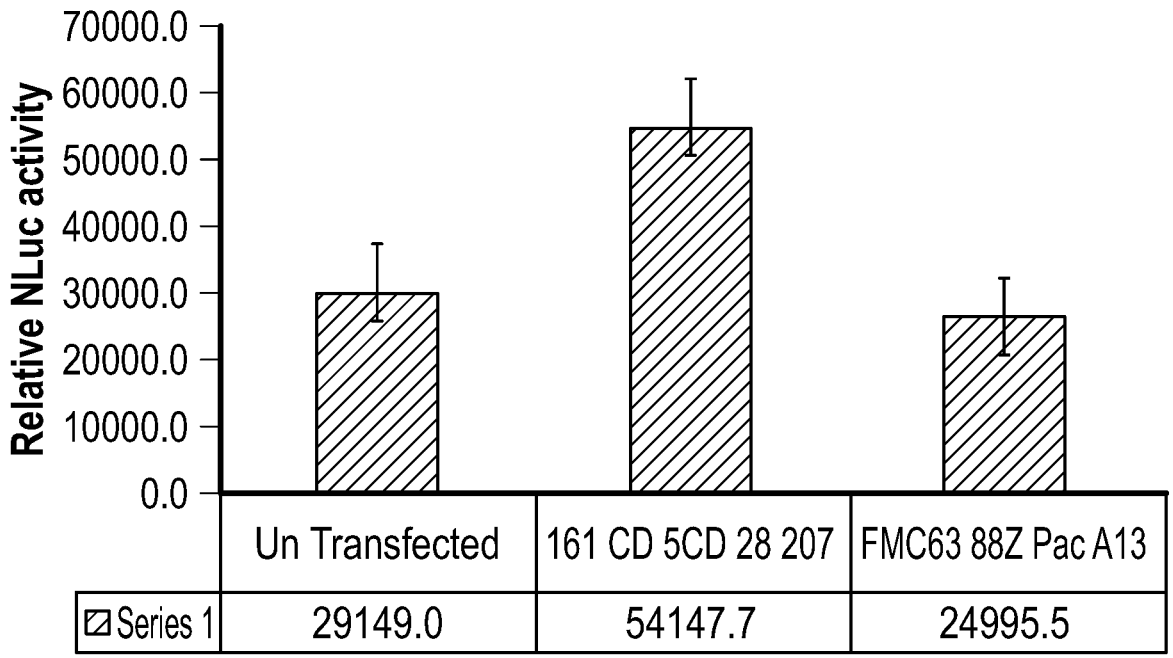

As shown in the FIG. 9A-B, 293FT cells expressing CD19 (FMC63-BBZ-PAC)-CAR demonstrated strong binding to Flag-CD19-GGSG-NLuc-AcV5 as measured by NLuc assay while very little binding was seen on uninfected T cells (UI) or those expressing control 161-BBZ-PAC CAR. Similarly, 293FT cells expressing 161-CD28Z-PAC CAR showed strong binding with MPL-GGSG-NLuc-AcV5 supernatant as compared to untransfected 293FT cells or those transfected with FMC63-BBZ-PAC CAR. The results demonstrate the ability of the GGSG-NLuc assay (or NLuc binding assay) to measure the binding of cell surface expressed chimeric receptor to their antigen target in a sensitive and quantitative manner. A number of other NLuc fusion proteins containing the extracellular domains of different potential targets of CARs and SIRs were constructed and validated using 293T or T cells expressing their corresponding CARs. The names, DNA and amino acid SEQ ID NOs of these constructs are provided in Table 71. Similar constructs can be generated against other antigen targets of SIRs by fusing their extracellular domains which are the target of CARs/SIRs to NLuc via a short flexible linker. CD20 is a type III membrane protein with two extracellular loops. The CD20-ECx2-ECD-GGSG-TurboLuc16-4xFlag-2xStreptag-8xHis-T2A-Pac (060816-I04) fusion construct was successfully generated and validated against CD20 CAR expressing cells. The amino acid sequence of this construct is represented by SEQ ID NO: 12374. Thus, it is possible to generate NLuc (or TurboLuc16)-fusion protein using any protein antigen target of a CAR or SIR, which can be used to detect the expression and binding affinity of the CAR/SIR-expressing cells.

Protein L is known to bind to kappa light chains. To detect the expression of kappa light chain containing CARs and SIRs, two NLuc fusion constructs containing an N-terminal Protein L coding region downstream of a CD8 signal peptide were constructed. The two constructs are identical except that the construct CD8SP-Protein-L-2-GGSG-NLuc-4× FLAG-x2STREP-8xHis-T2A-PAC (101916-P03) [SEQ ID NO: 12382] lacks a single amino acid in the Protein L coding region, which is present in the construct CD8SP-Protein-L-GGSG-NLuc-4xFLAG-x2STREP-8xHis-T2A-PAC (112316-Q02) [SEQ ID NO:12381]. The conditioned supernatant containing the fusion proteins were generated by transfection of the constructs in 293FT cells and was shown to bind to kappa light chain containing CAR constructs where the kappa light chain binds to Protein L. The antigen-Nluc fusion proteins such as CD19-ECD-GGSG-NLuc-AcV5 bind to the antigen binding domains of a CAR or a SIR and therefore can be used to measure the binding affinity of a CAR- or a SIR-expressing immune effector cell. In contrast, the Protein L-GGSG-NLuc fusion proteins bind to the kappa light chain component of a CAR or a SIR. As such, the main utility of these reagents is for detecting the expression of a CAR or a SIR and they can not be used to measure the binding affinity of a CAR or a SIR to their target antigen.

Figure 10A:
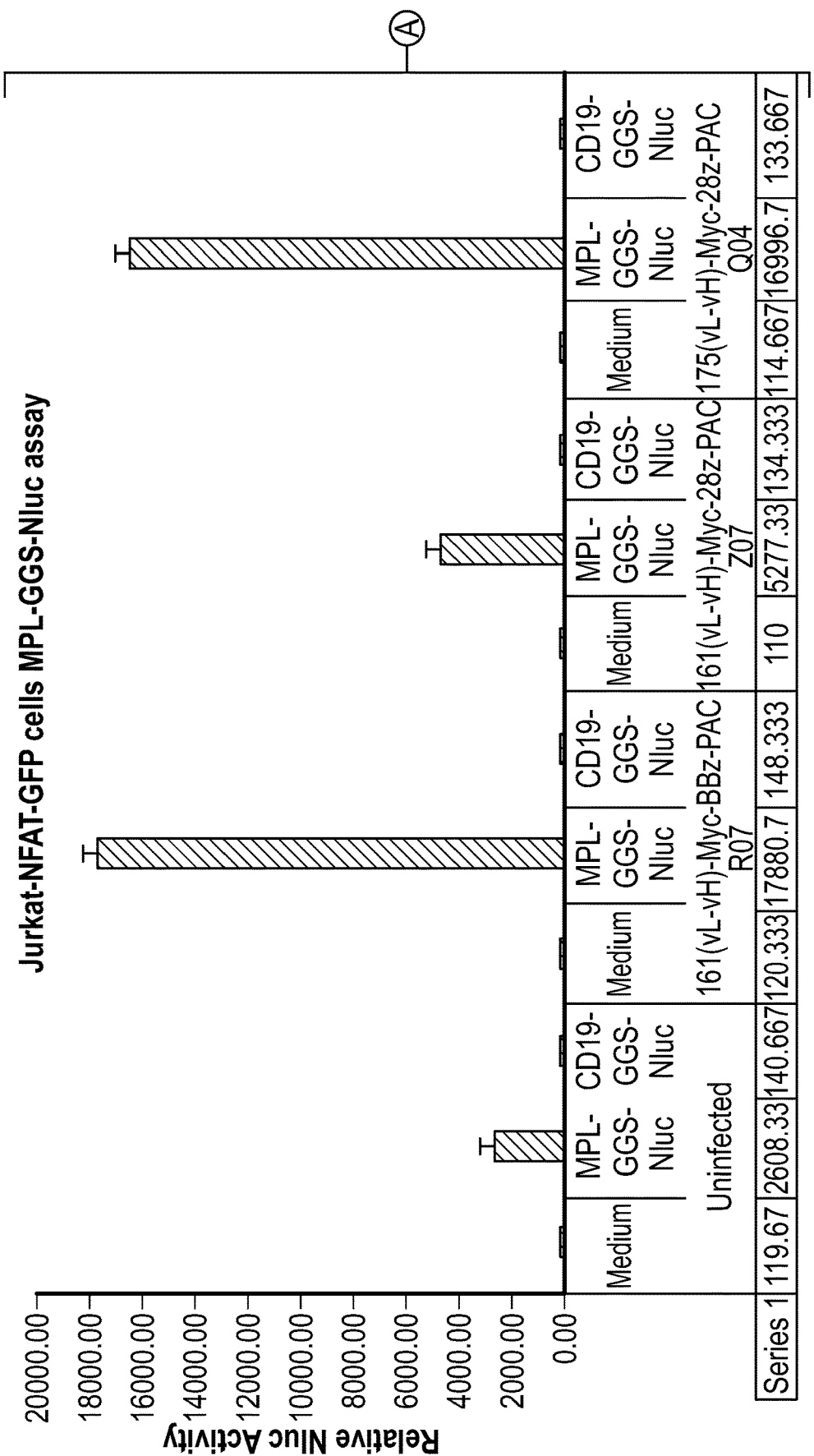
FIG. 10 shows strong binding of T cells expressing 161(vL+vH)-Myc-BBz-PAC R07, 175(vL+vH)-Myc-28z-PAC Q04, VB22(vL+vH)-Myc-28z-PAC B06 CARs and modest binding of T cells expressing 161(vL+vH)-Myc-28z-PAC Z07, AB317(vL+vH)-Myc-28z-PAC T04 and 12E10 (vL+vH)-Myc-28z-PAC B06 to MPL-GGSG-NLuc AcV5 supernatant, while no significant binding was observed on uninfected T cells or those expressing 4C3(vL+vH)-Myc-28z-PAC control CAR. Similarly, no specific binding was observed on any MPL CAR-T cells with CD19-GGSG-NLuc-AcV5 supernatant, thereby demonstrating the specificity of the assay.
Figure 10B:
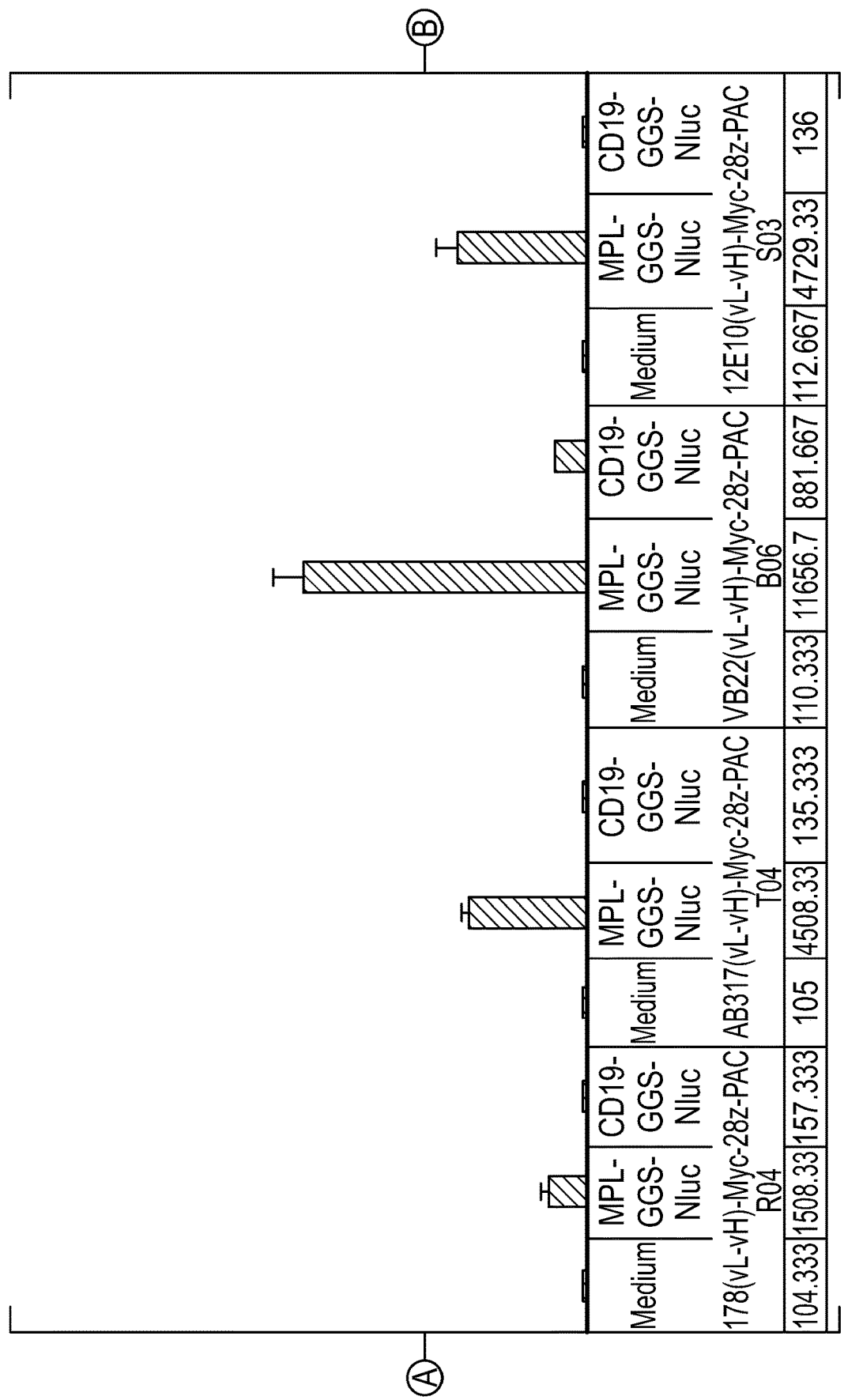
Figure 10C:
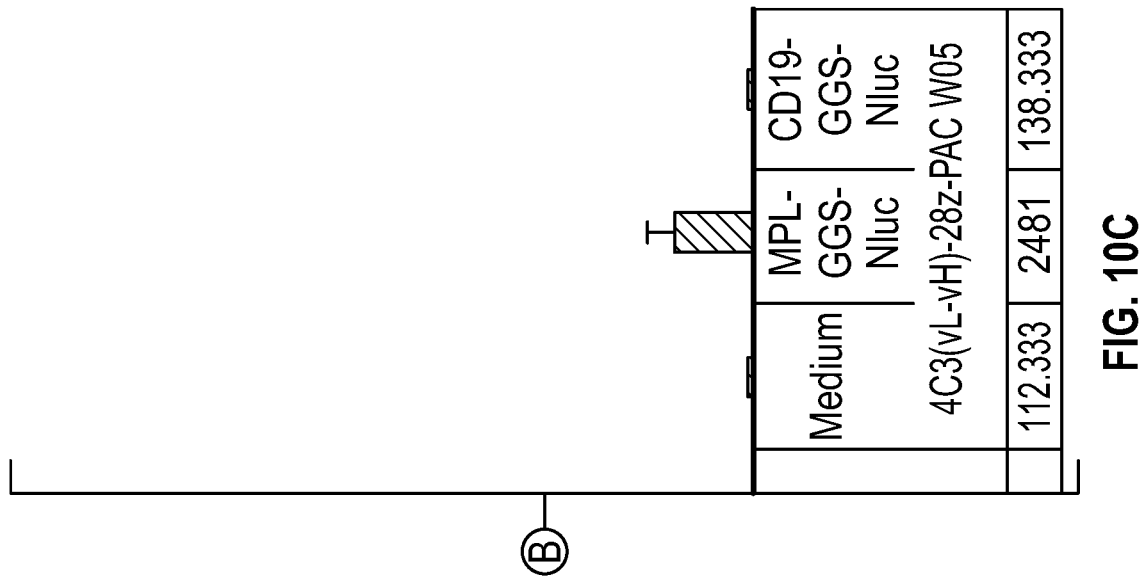

T cells expressing MPL CARs are capable of binding MPL-GGSG-NLuc fusion protein. Jurkat T cells expressing the different MPL CAR constructs or a control CAR (4C3) were incubated with MPL-GGSG-NLuc-AcV5 and CD19-GGSG-NLuc-AcV5 supernatants and after extensive washes assayed for NLuc activity essentially as described in the preceding example. The results are presented in FIG. 10 and demonstrate that Jurkat cells expressing the different MPL CAR constructs show different level of binding to MPL-GGSG-NLuc-AcV5 fusion protein. This difference could reflect the difference in the level of expression of the different constructs or a difference in the binding affinity of their respective scFv fragment to MPL or both.

Expression of SIRs on primary human T cells and their detection by NLuc assay. Human peripheral blood T cells isolated using CD3 magnetic beads were infected with lentiviruses expressing the indicated SIR constructs targeting CD19. A lentivirus vector encoding a SIR targeting MPL (161-SIR-U01) was used as a negative control. After the infection, cells were expanded in XVIVO media containing 10 ng/ml soluble anti-CD3, 10 ng/ml soluble anti-CD28 and 100 IU recombinant human-IL2 and selected with puromycin, unless indicated otherwise. T cells expressing the different SIR constructs were incubated with CD19-GGSG-NLuc-AcV5 supernatants and after extensive washes assayed for NLuc activity essentially as described in the preceding example. The data shows binding of CD19-GGSG-NLuc-AcV5 to T cells expressing the different SIRs. T cells expressing CD8SP-FMC63-vL-V5-[hTCRb-WT]-F-P2A-SP-FMC63-vH-Myc-[hTCRa-WT]-F-F2A-PAC (080815-F02) [SEQ ID NO:922], which contains the TCRα and TCRβ constant regions encoded by the wild-type human TCRα and human TCRβ2 nucleotide sequences, did not show any significant binding to CD19-GGSG-NLuc-AcV5 (mean NLuc value=1190) as compared to T cells expressing the negative control SIR 161-SIR-U01 (Mean NLuc value=1580). In contrast, T cells expressing CD8SP-FMC63-vL-V5-[mTCRb-opt]-F-P2A-SP-FMC63-vH-Myc-[mTCRa-opt]-F-F2A-PAC (080815-B06) [SEQ ID NO:953], which contains TCRα and TCRβ constant regions encoded by the codon optimized murine TCRα and murine TCRβ nucleotide sequences, show significant binding to CD19-GGSG-NLuc-AcV5 (Mean NLuc value=5359). T cells expressing CD8SP-FMC63-vL-V5-[TCRb-S57C-opt1]-F-P2A-SP-FMC63-vH-Myc-[TCRa-T48C-opt1]-F-F2A-PAC (050515-L05) [SEQ ID NO:900] show robust binding to CD19-GGSG-NLuc-AcV5 (Mean NLuc value=19178). This construct contains TCRα and TCRβ constant regions encoded by the codon optimized human TCRα and human TCRβ2 nucleotide sequences and carries S57C mutation in TCRβ constant chain and T48C mutation in the TCRα constant chain. The CD8SP-FMC63-vL-V5-[TCRb-S57C-opt1]-F-P2A-SP-FMC63-vH-Myc-[TCRa-T48C-opt1]-F-F2A-PAC (050515-L05) [SEQ ID NO:900] SIR construct also carries a V5 epitope tag between the FMC63-vL region and the TCRβ chain and a Myc tag between the FMC63-vH region and the TCRα chain. T cells expressing CD8SP-CD19Bu12-vL-V5-[TCRb-S57C-opt1]-F-P2A-SP-CD19Bu12-vH-Myc-[TCRa-T48C-opt1]-F-F2A-PAC (070215-M03) [SEQ ID NO:1021] SIR show stronger binding to CD19-GGSG-NLuc-AcV5 (Mean NLuc value=39575). This construct resembles the FMC63-based 050515-L05 construct except that it has vL and vH fragments derived from hCD19-Bu12 antibody, which is a humanized monoclonal antibody against human CD19. T cells expressing CD8SP-FMC63-vL-V5-[hTCRb-KACIAH]-F-P2A-SP-FMC63-vH-Myc-[hTCRa-CSDVP]-F-F2A-PAC (081415-D06) [SEQ ID NO:992] show strongest binding to CD19-GGSG-NLuc-AcV5 (Mean NLuc value=107077). This construct contains TCRα (TCRa) and TCRβ (TCRb) constant regions encoded by the codon optimized human TCRα and human TCRβ2 nucleotide sequences and carries S57C mutation in TCRβ constant chain and T48C mutation in the TCRα constant chain. The FMC63-SIR-D06 construct also carries a V5 epitope tag between the FMC63-vL region and the TCRβ chain and a Myc tag between the FMC63-vH region and the TCRα chain. Finally, in this construct, the TCRα and TCRβ constant chains are murinized. Thus, five amino acids of human TCR-b constant region were replaced by the corresponding murine amino acids. These murine amino acids were K-18, A-22, 1-133, A-136, and H-139. In addition, the region of murine TCRa constant chain containing the four amino acids Serine (S-90), aspartic acid (D-91), valine (V-92), and proline (P-93) were substituted in the human TCRa constant chain.

T cells expressing CD8SP-V5-[hTCRb-KACIAH]-F-P2A-CD8SP-FMC63-vL-Gly-Ser-Linker-FMC63-vH-Myc-[hTCRa-CSDVP]-F-F2A-PAC (082815-G07) [SEQ ID NO:1620] and CD8SP-V5-[hTCRb-KACIAH]-F-P2A-CD8SP-CD19Bu12-vL-Gly-Ser-Linker-CD19Bu12-vH-Myc-[hTCRa-CSDVP]-F-F2A-PAC (082815-E05) [SEQ ID NO:1622] SIR constructs also showed significant binding (Mean NLuc value=29262 and 4671.5, respectively) to CD19-GGSG-NLuc-AcV5. In the 082815-G07 construct, the FMC63-scFv fragment [i.e. FMC63(vL+vH)] is fused to TCRa-CSDVP fragment while the TCRb-KACIAH constant region fragment is expressed without any antigen binding moiety. The 082815-E05 construct is similar to 082815-G07 except that the CD19-Bu12 scFv fragment replaces the FMC63-scFv present in the 082815-G07 construct.

Figure 11A:
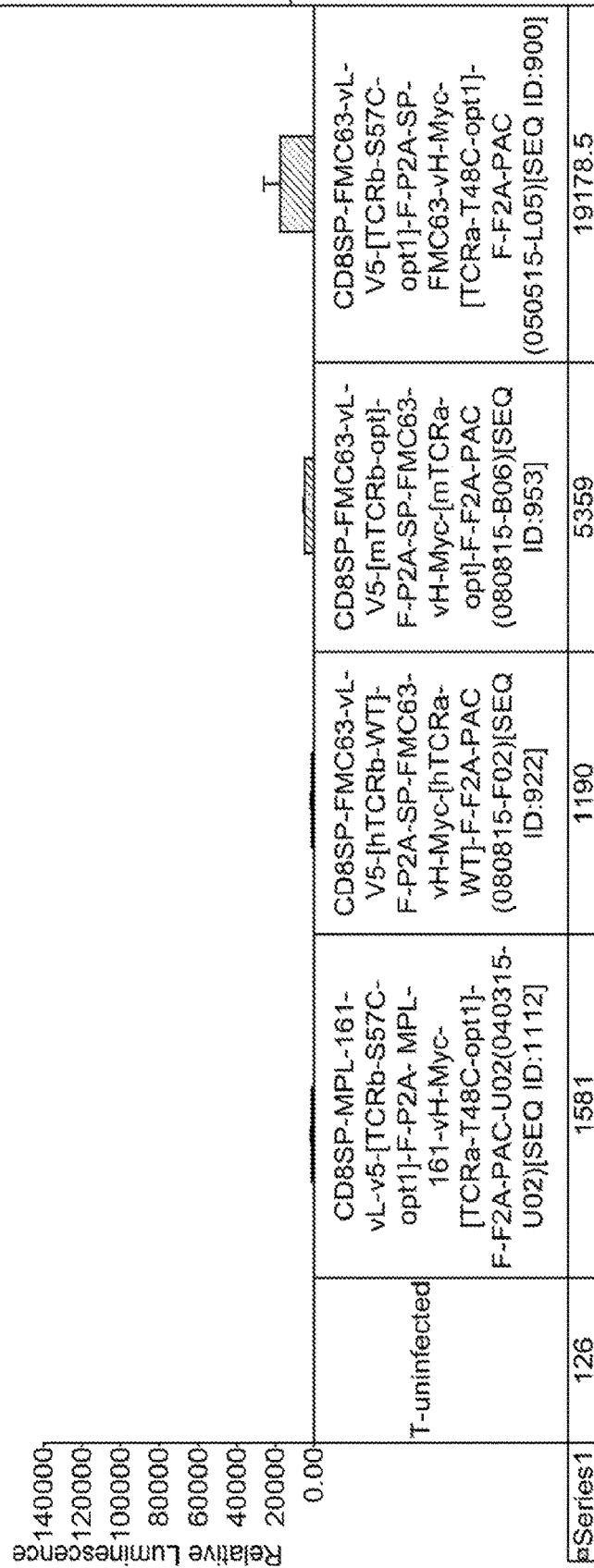
FIG. 11 shows a graph demonstrating that SIR containing TCRα and TCRβ constant regions encoded by wild-type nucleotide sequences fail to effectively express in human primary T cells. In contrast, SIR containing codon-optimized human TCRa/b chains carrying additional cysteine residue to promote interchain disulfide bonds are effectively expressed. Murinization of human TCRα/β constant chains, as seen in (081415-D06) [SEQ ID NO:992] SIR, leads to further increase in expression of SIR. Furthermore, as seen in the (082815-G07) [SEQ ID NO:1620] and (082815-E05) [SEQ ID NO:1622] constructs, scFv fragments can be expressed as fused to the TCRa constant region if they are coexpressed with a TCRb constant chain even if the TCRb does not bear any antigen binding moiety
Figure 11B:
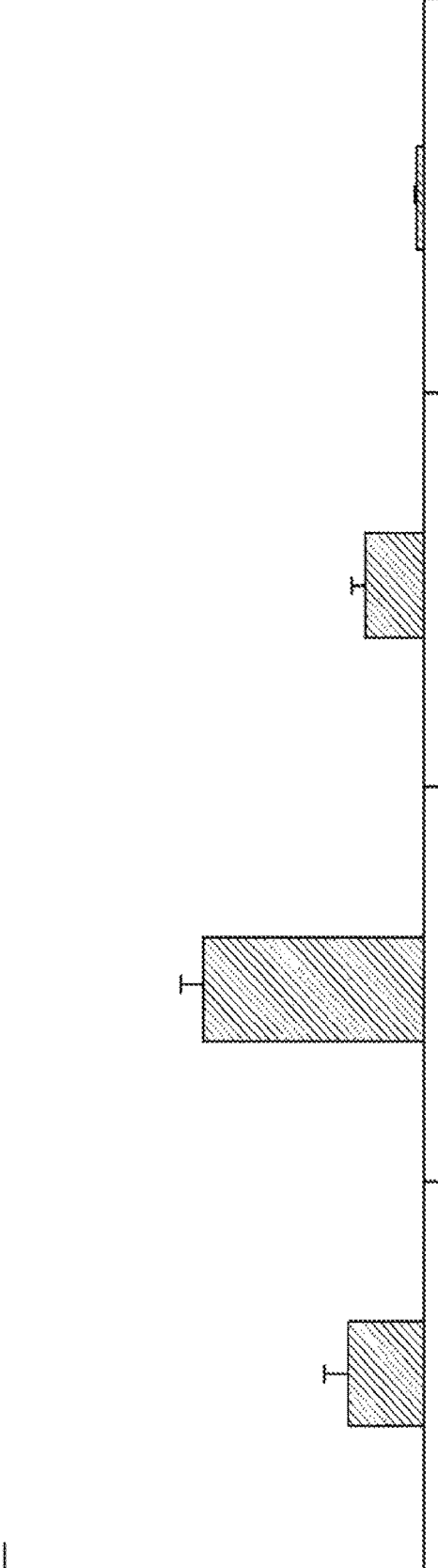
Figure 12:
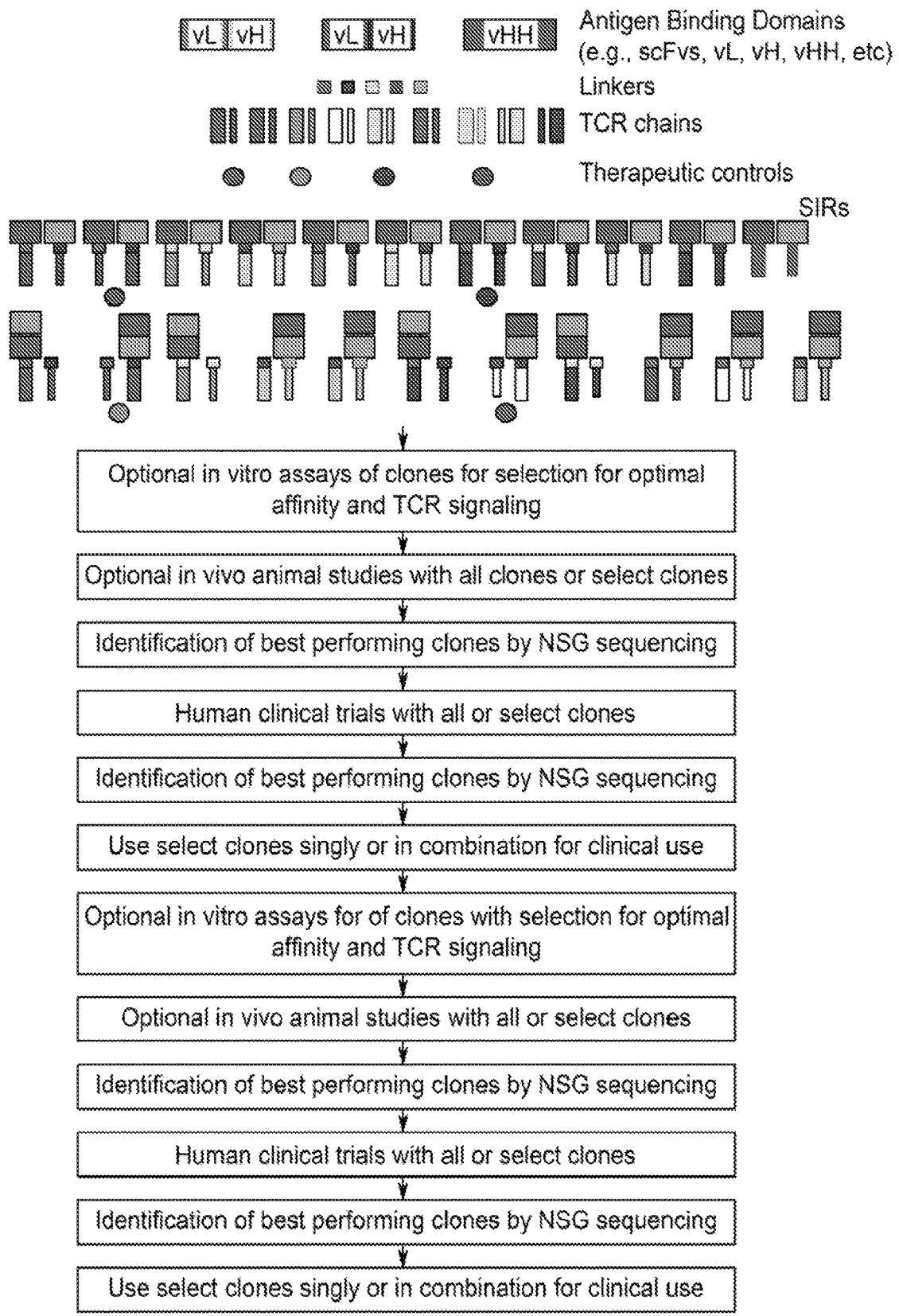
FIG. 12 shows a method of generating pools of SIRs with desired or diverse binding affinities.

Collectively, these results demonstrate that SIR containing TCRα and TCRβ constant regions encoded by wild-type nucleotide sequences fail to show significant binding to CD19, which is probably due to the poor expression of this construct in human primary T cells. In contrast, SIR containing codon-optimized human TCRa/b chains carrying additional cysteine residue to promote interchain disulfide bonds show effective CD19 binding and functional expression. Murinization of human TCRa/P constant chains, as seen in (081415-D06) [SEQ ID NO:992] SIR, leads to further increase in CD19 binding. Furthermore, as seen in the (082815-G07) [SEQ ID NO:1620] and (082815-E05) [SEQ ID NO:1622] constructs, scFv fragments can be functionally expressed as fused to the TCRa constant region if they are coexpressed with a TCRb constant chain even if the TCRb does not bear any antigen binding moiety (See, FIG. 11). Alternatively, the TCRb chain in such constructs could express an irrelevant vL or vH moiety as long as it does not interfere the functional assembly of the vL and vH chains present in the scFv fragment.

Jurkat-NFAT-Luc cells were stably transduced with the various constructs (SEQ ID NO: 922, 953, 900, 992, 1110 and 1021) and selected in puromycin. Cells were incubated with CD19-GGSG-NLuc-AcV5 supernatants and after extensive washes assayed for NLuc activity essentially as described previously. The NLuc values for the parental Jurkats and those expressing the different constructs were 996, 3606, 12128, 37216, 503043, 101958, and 128996, respectively. The experiments showed no significant binding of Jurkats expressing CD8SP-FMC63-vL-V5-[hTCRb-WT]-F-P2A-SP-FMC63-vH-Myc-[hTCRa-WT]-F-F2A-PAC (080815-F02) [SEQ ID NO:922] constructs containing TCRa/b constant chains with the wild-type nucleotide sequence to CD19-GGSG-NLuc AcV5 supernatant, while varying level of binding with other constructs that contain TCRa/b constant chains with codon optimized nucleotide sequences and/or carrying specific amino acid substitutions to enhance chain pairing and/or expression. In particular, the constructs with SEQ ID NO: 900 and 992 showed more than 10-fold and 15-fold increase in CD19-GGSG-NLuc binding, respectively.

Jurkat-NFAT-Luc cells were stably transduced with the different SIR constructs and selected in puromycin. Cells were incubated with CD19-GGSG-NLuc-AcV5 supernatants and after extensive washes assayed for NLuc activity essentially as described previously. The different SIR constructs show varying level of binding to CD19-GGSG-NLuc-AcV5 fusion protein. In particular, the construct CD8SP-FMC63-vL-V5-[hTCRg-opt]-F-P2A-SP-FMC63-vH-Myc-[hTCRd-opt]-F-F2A-PAC (091015-A06) [SEQ ID NO:949] which contains TCR constant chains derived from TCR-gamma and TCR-delta also showed binding to the CD19-GGSG-NLuc-AcV5 fusion protein. The NLuc values for the parental Jurkats and those expressing the constructs with SEQ ID NO: 1620, 1623, 1622, 926, 949, 1112 were 1515, 27594, 6357, 10254, 693, 2176 and 179, respectively. Thus, the construct with SEQ ID: 926 again showed the lowest binding to soluble CD19.

Jurkat-NFAT-Luc cells were stably transduced with the indicated constructs and selected in puromycin. Cells were incubated with CD19-GGSG-NLuc-AcV5 supernatants and after extensive washes assayed for NLuc activity essentially as described previously. The different SIR constructs showed varying level of binding to CD19-GGSG-NLuc-AcV5 fusion protein.

T cells expressing CD19 SIRs induce cytotoxicity in CD19-expressing RAJI lymphoma cells. Human peripheral blood T cells isolated using CD3 magnetic beads were infected with lentiviruses expressing the indicated SIR constructs targeting CD19. Cells selected with puromycin and expanded. RAJI cells stably expressing hGLuc intracellularly were cocultured with T cells expressing the SIRs at an Effector:Target (E:T) ratio of 10:1 for 4 hours. SIR-T cells mediated induction of lysis of target cells was assayed by increase of GLuc activity as measured by BioTek synergy plate reader by directly injecting 0.5×CTZ assay buffer containing native coeloentrazine (Nanaolight). The data demonstrate an increase in GLuc activity, indicating lysis of target cells, following co-culture with T cells expressing CD19-specific SIRs CD8SP-FMC63-vL-V5-[TCRb-S57C-opt1]-F-P2A-SP-FMC63-vH-Myc-[TCRa-T48C-opt1]-F-F2A-PAC (050515-L05) [SEQ ID NO:900] and CD8SP-CD19Bu12-vL-V5-[TCRb-S57C-opt1]-F-P2A-SP-CD19Bu12-vH-Myc-[TCRa-T48C-opt1]-F-F2A-PAC (070215-M03) [SEQ ID NO:1021] as compared to T cells expressing the control SIR CD8SP-MPL-161-vL-V5-[hT-CRb-S57C-opt1]-F-P2A-MPL-161-vH-Myc-[hTCRa-T48C-opt1]-F-F2A-PAC (040315-U02) [SEQ ID NO:1112] targeting MPL. Treatment with digitonin was used to show maximum cell death. The mean Gluc values for RAJI cells exposed to T cells expressing constructs (040315-U02) [SEQ ID NO:1112], (050515-L05) [SEQ ID NO:900], (070215-M03) [SEQ ID NO:1021] and following digitonin treatment were 119, 3042, 2547, and 3869, respectively.

T cells expressing CD19 SIRs induce cytotoxicity in CD19-expressing RAJI lymphoma. Human peripheral blood T cells isolated using CD3 magnetic beads were infected with lentiviruses expressing the indicated SIR constructs targeting CD19 or left uninfected (T-UI). Cells were selected with puromycin and expanded. RAJI cells stably expressing hGLuc were cocultured with T cells expressing the SIRs at an Effector:Target (E:T) ratio of 10:1 for 4 hours. SIR-T cells mediated induction of lysis of target cells was assayed by increase of GLuc activity as measured by BioTek synergy plate reader by directly injecting 0.5×CTZ assay buffer containing native coeloentrazine (Nanaolight). Glue activity in wells containing media alone (Med) and in wells in which target cells were incubated with T cells that were not infected with any SIR construct (T-UI) were used as controls in this and subsequent experiments where indicated. The data showed an increase in GLuc activity, indicating lysis of target cells, following co-culture with T cells expressing CD19-specific SIRs CD8SP-FMC63-vL-V5-[TCRb-S57C-opt1]-F-P2A-SP-FMC63-vH-Myc-[TCRa-T48C-opt1]-F-F2A-PAC (050515-L05) [SEQ ID NO:900], CD8SP-FMC63-vL-V5-[hTCRb-WT]-F-P2A-SP-FMC63-vH-Myc-[preTCRa-Del48]-F-F2A-PAC (091015-Y08) [SEQ ID NO:926], and CD8SP-FMC63-vL-V5-[hTCRb-KACIAH]-F-P2A-SP-FMC63-vH-Myc-[hTCRa-CSDVP]-F-F2A-PAC (081415-D06) [SEQ ID NO:992] as compared to T cells expressing the control SIR CD8SP-MPL-161-vL-V5-[hT-CRb-S57C-opt1]-F-P2A-MPL-161-vH-Myc-[hTCRa-T48C-opt1]-F-F2A-PAC (040315-U02) [SEQ ID NO:1112] targeting MPL or uninfected T cells (T-UI). Treatment with digitonin was used to show maximum cell death. The result with (091015-Y08) [SEQ ID NO:926] construct shows that preTCRα-del48 constant chain fragment can substitute for TCRα constant chain region in making a functional double chain SIR when coexpressed with constant chain of TCRβ. Please note that med indicates media alone while T-UI denotes T cells that were not infected with any SIR construct.

T cells expressing CD19 single chain SIRs in which the antigen binding domain is joined to one of the TCR constant chains and which lack the complementary TCR chain fail to induce significant cytotoxicity in CD19-expressing RAJI lymphoma. SIR constructs were generated in which the scFv fragments derived from CD19Bu12 and FMC63 monoclonal antibodies directed against human CD19 antigen were fused to the constant chain of TCRb and complementary TCRa chain was not expressed. In the construct CD8SP-CD19Bu12-vL-Gly-Ser-Linker-CD19Bu12-vH-V5-[hT-CRb-WT]-F-P2A-PAC (051216-D08) [SEQ ID NO:1022], the scFV fragment of CD19Bu12 (represented as CD19Bu12-vL-Gly-Ser-Linker-CD19Bu12-vH) is joined to the TCRb constant chain containing the wild-type nucleotide sequence via the V5 linker. In the construct CD8SP-FMC63-vL-Gly-Ser-Linker-FMC63-vH-V5-[hTCRb-S57C-opt]-F-P2A-PAC (051216-G01) [SEQ ID NO:912], the scFV fragment of FMC63 (represented as FMC63-vL-Gly-Ser-Linker-FMC63-vH) is joined to the TCRb constant chain containing its codon optimized nucleotide sequence and carrying the S57C mutation via the V5 linker. In the construct CD8SP-V5-[hTCRb-KACIAH]-F-P2A-CD8SP-FMC63-vL-Gly-Ser-Linker-FMC63-vH-Myc-[hTCRa-CSDVP]-F-F2A-PAC (082815-G07) [SEQ ID NO:1620], the scFV fragment of FMC63 is joined to the TCRa constant chain containing its codon optimized nucleotide sequence and carrying the CSDVP mutations via the MYC linker, which is coexpressed with the TCRb constant chain containing its codon optimized nucleotide sequence and carrying the KACIAH mutations via the V5 linker. The constructs CD8SP-FMC63-vL-V5-[hTCRb-KACIAH]-F-P2A-SP-FMC63-vH-Myc-[hTCRa-CSDVP]-F-F2A-PAC (081415-D06) [SEQ ID NO:992] and CD8SP-FMC63-vL-V5-[hT-CRb-KACIAH]-F-P2A-SP-FMC63-vH-Myc-[hTCRa-CSDVP]-F-F2A-K13-FLAG-F-T2A-PAC (051216-K04) [SEQ ID NO:918] are double chain constructs in which the vL and vH fragments derived from FMC63 are attached to hTCRb-KACIAH and hTCRa-CSDVP chains respectively.

The different constructs were expressed in T cells and tested for their ability to lyse RAJI-Gluc cells as before. The data shows that T cells expressing the (051216-D08) [SEQ ID NO:1022] and (051216-G01) [SEQ ID NO:912] SIRs, which lack the complementary TCRa constant chain, failed to induce lysis of RAJI cells as compared to uninfected T cells (T-UI) or wells containing the medium alone. RAJI-GLuc cells exposed to T cells expressing constructs (082815-G07) [SEQ ID NO:1620], (051216-K04) [SEQ ID NO:918] and (081415-D06) [SEQ ID NO:992] showed more than 2-fold, more than 2-fold, and more than 4 fold increase in Gluc activity as compared to those exposed to T-UI cells.

T cells expressing CD19 single chain SIRs (SC SIR) in which the antigen binding domain is joined to one of the TCR constant chains and which lack the complementary TCR chain fail to induce cytotoxicity in CD19-expressing RAJI lymphoma. Human peripheral blood T cells isolated using CD3 magnetic beads were infected with lentiviruses expressing the indicated SIR constructs targeting CD19. Cells were selected with puromycin and expanded. RAJI cells stably expressing hGLuc were cocultured with T cells expressing the SIRs at an Effector:Target (E:T) ratio of 10:1 for 4 hours. SIR-T cells mediated induction of lysis of target cells was assayed by increase of GLuc activity as measured by BioTek synergy plate reader by directly injecting 0.5× CTZ assay buffer containing native coelentrazine (Nanaolight). Data shows that T cells expressing the SIR constructs (051216-D08) [SEQ ID NO:1022], (051216-F03) [SEQ ID NO:1023] and (051216-G01) [SEQ ID NO:912] SIRs, in which the antigen binding domain is joined to the TCRb constant chains and which lack the complementary TCRa constant chain, failed to induce lysis of RAJI cells as compared to uninfected T cells (T-UI) or wells containing media alone.

T cells expressing CD19 SIRs induce cytotoxicity in CD19-expressing RAJI lymphoma. Human peripheral blood T cells isolated using CD3 magnetic beads were infected with lentiviruses expressing the different SIR constructs targeting CD19. A construct targeting TCRβ2 chain (CD8SP-V5-[hTCRb-KACIAH]-F-P2A-CD8SP-TCRB2-CP01-E05-vL-Gly-Ser-Linker-TCRB2-CP01-E05-vH-Myc-[hTCRa-CSDVP]-F-F2A-PAC (030816-C05) [SEQ ID NO:1781]) was used as a negative control. Cells were left unselected (for constructs 022216-A04 and 031416-A18) or selected with puromycin (for other constructs) and expanded. Cells were tested for their ability to lyse RAJI-Gluc cells. The results show effective target cell lysis by T cells expressing all constructs as compared to uninfected T cells (T-UI) or wells with medium alone (Med). In particular, effective target cell lysis is observed by constructs (031616-B05) [SEQ ID NO: 1019], (031616-C05) [SEQ ID NO: 1020], (021816-N02) [SEQ ID NO: 1016] where CD19Bu12 scFv fragment is attached to a TCRb constant chain and is coexpressed with an empty hTCRa constant chain. Effective target cell lysis is also observed by the construct CD8SP-V5-[hTCRb-KACIAH]-F-P2A-CD8SP-2-CD19MM-vL-Gly-Ser-Linker-CD19MM-vH-Myc-[hT-CRa-CSDVP]-F-F2A-PAC (031616-A05) [SEQ ID NO:1623] in which the CD19MM scFv is attached to hTCRa-CSDVP constant chain via a Myc linker and is coexpressed with an empty hTCRb-KACIAH constant chain carrying a V5 linker. Effective target cell lysis was also observed by construct CD8SP-CD19Bu12-scFv-V5-[hT-CRb-KACIAH]-F-P2A-SP-FMC63-scFv-Myc-[hTCRa-CSDVP]-F-F2A-PAC (020216-B07) [SEQ ID NO:1026] in which the CD19Bu12 scFv is attached to hTCRb-KACIAH chain and FMC63-scFv is attached to hTCRa-CSDVP chain, thereby demonstrating that functional SIR can be constructed containing two different scFv fragments. Finally, effective target cell lysis was also observed by constructs CD8SP-FMC63-vL-V5-[hTCRb-KACIAH]-F-P2A-SP-FMC63-vH-Myc-[hTCRa-CSDVP]-F-F2A-K13-FLAG-F-T2A-CNB30 (022216-A04) [SEQ ID NO:920] and CD8SP-FMC63-vL-V5-[hTCRb-KACIAH]-F-P2A-SP-FMC63vH-MYC-[hTCRa-CSDVP]-F-P2A-CD3z-41BB-T2A-CNB30 (031416-A18) [SEQ ID NO:998] in which FMC63 derive vL and vH fragments are attached to hTCRb-KACIAH and hTCRa-CSDVP constant chains, respectively. However, these constructs co-express Kaposi's sarcoma associated herpesvirus encoded viral FLICE inhibitory protein (vFLIP) K13 and a fusion protein CD3z-41BB, respectively. The K13 protein is known to selectively activate the NF-κB pathway by binding to cellular protein NEMO while CD3z-41BB fusion protein contains the cytosolic signaling domain of costimulatory molecule 41BB joined to the CD3z chain of TCR complex. By providing costimulatory signals, K13 and CD3z-41BB proteins will enhance the activation and proliferation of SIR-expressing cells, leading to better functionality and long-term persistence. The 022216-A04 and 031416-A18 constructs also express the CNB30 mutant of calcineurin B chain, which confers resistance to calcineurin inhibitors, such as FK506 (Tacrolimus).

T cells expressing double chain (DC) and one-and-half chain (OAH) SIRs targeting CD19 induce cytotoxicity in CD19-expressing RAJI lymphoma. T cells were infected with lentiviruses expressing different SIR constructs targeting CD19 and tested for cytotoxicity against RAJI-Gluc cells. The data shows that the CD8SP-FMC63-vL-V5-[hTCRb-WT]-F-P2A-SP-FMC63-vH-Myc-[hTCRa-WT]-F-F2A-PAC (080815-F02) [SEQ ID NO:922] SIR construct that contains TCRβ and TCRα constant chains encoded by their wild-type nucleotide sequences (i.e. SEQ ID NO: 746 and SEQ ID NO: 731, respectively) fails to cause significant target cell lysis as compared to the negative control construct CD8SP-MPL-161-vL-V5-[hTCRb-S57C-opt1]-F-P2A-MPL-161-vH-Myc-[hTCRa-T48C-opt1]-F-F2A-PAC (040315-U02) [SEQ ID NO:1112] targeting MPL. In contrast, all other SIR constructs (e.g. (050515-L05) [SEQ ID NO:900], (070215-M03) [SEQ ID NO:1021], (081415-D06) [SEQ ID NO:992], (080815-B06) [SEQ ID NO:953], (082815-G07) [SEQ ID NO:1620] and (082815-E05) [SEQ ID NO:1622]) showed increase in GLuc activity, indicating lysis of target cells. The (082815-G07) [SEQ ID NO:1620] and (082815-E05) [SEQ ID NO:1622] constructs express empty hTCRb-KACIAH (SEQ ID NO: 748) constant chains along with the hTCRa-CSDVP (SEQ ID NO: 732) constant chain fragment to which the FMC63 and CD19Bu12 scFV fragments are fused, respectively. Thus, SIR in which the antigen binding domain is fused to TCRa constant chain can induce effective target cell lysis if it is coexpressed with an empty complementary TCRb constant chain. The empty TCRb constant chain in such SIR constructs probably facilitate cell surface expression of the TCRa constant chain carrying the antigen binding domain.

T cells expressing a CD19Bu12 SIR with wild-type nucleotide sequences of TCRa and TCRb constant chains fail to induce cytotoxicity in CD19-expressing RAJI lymphoma. RAJI-Gluc cells were cocultured with T cells expressing the different SIRs targeting CD19 at an Effector:Target (E:T) ratio of 10:1 for 4 hours. SIR-T cells mediated induction of lysis of target cells was assayed as before. The data shows that the T cells expressing the CD19Bu12 based CD8SP-CD19Bu12-vL-V5-[hTCRb-WT]-F-P2A-CD19Bu12-vH-Myc-[hTCRa-WT]-F-F2A-PAC (021916-Q03) [SEQ ID NO: 1038] SIR construct that contains TCRb and TCRa constant chains encoded by their wild-type nucleotide sequences fails to cause significant target cell lysis as compared to the negative control construct 111815-O05 or uninfected T cells, which is probably due to poor expression of the 021916-Q03 SIR construct in human primary T cells. Therefore, similar to the CD8SP-FMC63-vL-V5-[hTCRb-WT]-F-P2A-SP-FMC63-vH-Myc-[hTCRa-WT]-F-F2A-PAC (080815-F02) [SEQ ID NO:922] construct, another SIR based on wild-type nucleotide sequences of TCRa and TCRb chains failed to induce significant toxicity against the target cell line.

T cells expressing one and half chain (OAH SIR) targeting CD19 induce cytotoxicity in CD19-expressing RAM lymphoma. Human peripheral blood T cells were infected with lentiviruses encoding different SIRs targeting CD19 and tested for cytotoxicity using RAJI-Gluc cells at an Effector:Target (E:T) ratio of 1:1 for 96 hours. The data showed that the CD8SP-FMC63-vL-V5-[hTCRb-WT]-F-P2A-SP-FMC63-vH-Myc-[hTCRa-WT]-F-F2A-PAC (080815-F02) [SEQ ID NO:922] SIR construct that contains TCRb and TCRa constant chains encoded by their wild-type nucleotide sequences fails to cause significant target cell lysis as compared to the negative control construct 040315-U02, which is probably due to poor expression of this (i.e. 080815-F02) construct in human primary T cells. In contrast, all other SIR constructs (e.g. 050515-L05, 070215-M03, 081415-D06, 080815-B06, 082815-G07 and 082815-E05) showed increase in GLuc activity, indicating lysis of target cells. The 082815-G07 and 082815-E05 constructs express the TCRb constant chain (KACIAH version) along with the TCRa (CSDVP) fragment to which the FMC63 and CD19Bu12 scFV fragments are fused, respectively. Thus, a SIR based on an antigen binding domain fused to TCRa constant chain can induce effective cell lysis if it is coexpressed with an empty TCRb constant chain. Such a SIR is designated one-and-half (OAH SIR). Thus, OAH SIRs are more effective than single chain SIR (SC SIR). This is probably because TCRa and TCRb need the complementary chain for efficient expression on T cells.

T cells expressing double chain (DC SIR) targeting CD19 induce cytotoxicity in CD19-expressing RAJI lymphoma. RAJI-Gluc cells were cocultured with T cells expressing the different SIRs targeting CD19 at an Effector:Target (E:T) ratio of 10:1 for 4 hours followed by measurement of Gluc activity. The data showed that T cells expressing the CD8SP-FMC63-vL-Myc-[hTCRa-T48C-opt1]-F-F2A-FMC63-vH-V5-[hTCRb-C57C-opt1]-F-P2A-PAC (100515-E03) [SEQ ID NO:902] construct in which the FMC63-vL chain is joined to hTCRa-T48C-opt1 constant chain and the FMC63-vH is joined to hTCRb-C57C-opt1 constant chain can induce effective lysis of the target cells as compared to uninfected T cells or T cells expressing negative control CARs targeting CD4 or a KSHV protein. Similarly, T cells expressing CD8SP-FMC63-vL-V5-[TCRb-S57C-opt1]-F-P2A-SP-FMC63-vH-Myc-[TCRa-T48C-opt1]-F-F2A-PAC (050515-L05) [SEQ ID NO:900] and CD8SP-FMC63-vL-V5-[hTCRb-S57C-opt]-F-P2A-SP-FMC63-vH-Myc-[hTCRa-T48C-opt]-F-F2A-PAC (100815-B04) [SEQ ID NO:951] constructs, in which the FMC63-vL chain is joined to TCRb-S57C-opt1 or hTCRb-S57C-opt constant chains and the FMC63-vH is joined to TCRa-T48C-opt1 or hTCRa-T48C-opt constant chains induced effective target cell lysis. Finally, T cells expressing the IgHSP-FMC63-vH-[hTCRb-C57C-opt]-F-P2A-CD8SP-FMC63-vL-MYC-[hTCRa-T48C-opt]-F-F2A-Pac (101415-M05) [SEQ ID NO:901] construct in which the in which the FMC63-vH chain is joined to hTCRb-C57C-opt constant chain and the FMC63-vL is joined to hTCRa-T48C-opt constant chain can also induce effective lysis of the target cells. Thus, in a double chain SIR construct the vL fragment of an antibody can be joined to either the TCRa or the TCRb constant chain and the vH fragment joined to either of the complementary TCRb or the TCRa constant chain. In addition, in a double chain SIR, where both the functional polypeptide units (FPU) are expressed from the same vector, either the TCRb or the TCRa chain containing FPU could be the first (or the 5') FPU.

T cells expressing CD20 SIR induces cytotoxicity in CD20-expressing RAJI cells. RAJI-Gluc cells were cocultured with T cells expressing the different SIRs targeting CD19 and CD20 at an Effector:Target (E:T) ratio of 10:1 for 4 hours followed by measurement of Gluc activity. The data showed the effective induction of target cell lysis by T cells expressing CD8SP-CD20-2F2-vL-V5-[hTCRb-KACIAH]-F-P2A-SP-CD20-2F2-vH-Myc-[hTCRa-CSDVP]-F-F2A-PAC (100615-D05) [SEQ ID NO:1221] SIR as compared to uninfected T cells or wells containing media (Med) alone.

Modest cytotoxicity was also observed with the SIR constructs (CD8SP-FMC63-vL-V5-[TCRb-S57C-opt1]-F-P2A-SP-FMC63-vH-Myc-[TCRa-T48C-opt1]-F-F2A-PAC (050515-L05) [SEQ ID NO:900] and CD8SP-FMC63-vL-V5-[hTCRb-S57C-opt]-F-P2A-SP-FMC63-vH-Myc-[hTCRa-T48C-opt]-F-F2A-PAC (100815-B04) [SEQ ID NO:951]) targeting CD19.

T cells expressing CD20 SIR containing canine TCRa and canine TCRb constant chains induce cytotoxicity in CD20-expressing RAJI cells. Human peripheral blood T cells isolated using CD3 magnetic beads were infected with lentiviruses expressing a SIR construct targeting CD20 in which the vL and vH fragments of a monoclonal antibody against human CD20 (2F2) are joined to codon optimized canine TCRa and TCRb constant chains. Cells were tested for cytotoxicity against RAJI-Gluc cells after 4 hours co-culture at E:T ratio of 10:1. The data shows effective induction of target cell lysis by T cells expressing the CD8SP-CD20-2F2-vL-[canine-TCRb-opt]-F-P2A-CD20-2F2-vH-[canine-TCRa-opt]-F-F2A-PAC (051716-E02) [SEQ ID NO:1113] based on canine TCRb and TCRa constant chains as compared to uninfected T cells.

T cells expressing Lym1 SIRs induce cytotoxicity in Lym1-expressing Kasumi-1 cells. Human T cells were infected with a lentivirus encoding CD8SP-Lym1-vL-[hTCRb-opt2]-F-P2A-SP-Lym1-vH-[hTCRa-opt2-Del]-F-F2A-PAC (012716-B01) [SEQ ID NO: 1185] SIR and following selection with puromycin tested for cytotoxicity against Kasumi-1-GLuc cells at an Effector:Target (E:T) ratio of 10:1 for 4 hours or uninfected T cells (T-UI) as control. Cytotoxicity was assayed by increase of GLuc activity. The data showed effective induction of target cell lysis by T cells expressing the (012716-B01) [SEQ ID NO: 1185] SIR with nearly a 9-fold increase in Gluc activity as compared to uninfected T cells or wells containing media alone.

T cells expressing Lym1 and Lym2 SIRs induce cytotoxicity in Lym1 & Lym2-expressing RAM cells. T cells expressing SIR targeting Lym1 and Lym2 were tested against RAJI-Gluc cells after 4 hours co-culture at an E:T ratio of 10:1. The data from Gluc-cytotoxicity assay showed effective induction of target cell lysis by both CD8SP-Lym1-vL-V5-[hTCRb-KACIAH]-F-P2A-SP-Lym1-vH-Myc-[hTCRa-CSDVP]-F-F2A-PAC (021216-H02) [SEQ ID NO:1314] and CD8SP-Lym2-vL-V5-[hTCRb-KACIAH]-F-P2A-SP-Lym2-vH-Myc-[hTCRa-CSDVP]-F-F2A-PAC (100615-B07) [SEQ ID NO:1315] SIR constructs with Gluc values nearly more than 20-fold and 10-fold higher, respectively, as compared to a control SIR (SEQ ID NO: 4639) expressing T cells, uninfected T cells or media alone. The 082815-P08 is a conventional CAR containing CD19Bu12 scFv and targeting CD19 antigen. T cells expressing the CD19Bu12 based (021916-Q03) [SEQ ID NO: 1038] SIR construct that contains TCRb and TCRa constant chains encoded by their wild-type nucleotide sequences again failed to cause significant target cell lysis.

T cells expressing SIR against CS1 (SLAMF7 or CD319) induce cytotoxicity in CS1-expressing L363 and U266 cells. Human peripheral blood T cells isolated using CD3 magnetic beads were infected with lentiviruses expressing a SIR construct targeting CS1 (SLAMF7). Cells were selected with puromycin and tested for cytotoxicity against L363-Gluc and U266-Gluc cells at an E:T ratio of 10:1 for 4 hours. Gluc-cytotoxicity assay showed effective induction of L363-Gluc and U266-Gluc lysis, as evident by a nearly more than 15-fold and 10-fold increase in Gluc values, by T cells expressing the CD8SP-CS1-huLuc90-vL-V5-[hTCRb-KACIAH]-F-P2A-SP-huLuc90-vH-Myc-[hTCRa-CSDVP]-F-F2A-PAC (012716-A02) [SEQ ID NO:1254] SIR as compared to uninfected T cells or wells containing media alone.

T cells expressing SIR against BCMA (B cell maturation antigen or TNFRSF17 or CD269) and CSI induce cytotoxicity in BCMA-expressing L363 and U266 cells. Human peripheral blood T cells isolated using CD3 magnetic beads were infected with lentiviruses expressing SIRs construct targeting CS1 (SLAMF7) and BCMA. Cells were selected with puromycin and tested for cytotoxicity against L363-Gluc and U266-Gluc cells at an E:T ratio of 10:1 for 4 hours. The Gluc cytotoxicity assay showed effective induction of target cell lysis by T cells expressing the CD8SP-BCMA-huC12A3-L3H3-vL-V5-[hTCRb-KACIAH]-F-P2A-SP-BCMA-huC12A3-L3H3-vH-Myc-[hTCRa-CSDVP]-F-F2A-PAC (011116-A07) [SEQ ID NO:1212] and CD8SP-CS1-huLuc90-vL-V5-[hTCRb-KACIAH]-F-P2A-SP-huLuc90-vH-Myc-[hTCRa-CSDVP]-F-F2A-PAC (012716-A02) [SEQ ID NO:1254] SIRs as compared to uninfected T cells, T cells expressing the control SIR CD8SP-KSHV-4C3-vL-V5-[hTCRb-S57C-opt]-F-P2A-SP-4C3-vH-Myc-[hTCRa-T48C-opt]-F-F2A-PAC (111815-005) [SEQ ID NO: 4639] or wells containing media alone. Mild to modest target cell lysis was also observed by T cells expressing the SIR CD8SP-V5-[hTCRb-KACIAH]-F-P2A-CD8SP-LAMP1-Mb4-vL-Gly-Ser-Linker-LAMP1-Mb4-vH-Myc-[hTCRa-CSDVP]-F-F2A-PAC (050216-F05) [SEQ ID NO:1732] targeting LAMP1 and the bispecific CAR 041316-F06 targeting cMet and Her3.

T cells expressing SIR against CD138, CS1, GPRC5D and WT1 induce cytotoxicity in U266 and L363 cells. T cells expressing SIR constructs targeting CD138, CS1, GPRC5D and WT1 were selected with puromycin and tested against U266 and L363 cells stably expressing GLuc at an E:T ratio of 2:1 for 72 hours. The Gluc-cytotoxicity assay showed a effective induction of target cell lysis by T cells expressing the CD8SP-CD138-vL-V5-[hTCRb-KACIAH]-F-P2A-SP-CD138-vH-Myc-[hTCRa-CSDVP]-F-F2A-PAC (100815-A05) [SEQ ID NO:1236] SIR as compared to uninfected T cells or wells containing media (Med) alone. T cells expressing the SIR CD8SP-CD138-vL-V5-[hTCRb-WT]-F-P2A-SP-CD138-vH-Myc-[hTCRa-WT]-F-F2A-PAC (021916-R04) [SEQ ID NO:1139] which contains wild-type TCRa and TCRb constant chains was only minimally effective in U266 cells and not effective in L363 cells. The single chain SIR CD8SP-CD138-vL-Gly-Ser-Linker-CD138-vH-Myc-[hTCRa-CSDVP]-F-F2A-PAC (030316-G03) [SEQ ID NO:1169] in which the CD138 scFv is attached to hTCRa-CSDVP constant chain was only effective in U266 cells. The bispecific construct LAMP1-humab1-2-vL-V5-[TCRb-KACIAH]-F-P2A-GPRC5D-ET150-18-vH-MYC-[TCRa-CSDVP]-F-F2A-Pac-E05 (092916-E05-VN) (SEQ ID NO: 1163) which carries the vL fragment of an antibody against LAMP1 and vH fragment of an antibody against GPRC5D also effectively induced cytotoxicity in both cell types. Finally, mild to modest cytotoxicity was observed with constructs targeting CS1 and WT1, especially in U266 cells. The limited cytotoxicity of constructs against CS1 (SEQ ID NO: 1674, 1253) and WT1 (SEQ ID NO: 1804 and 1805) could be due to use of lower E:T ratio in this experiment.

T cells expressing SIR against CLL1 induce cytotoxicity in CLL1-expressing HL60 cells. T cells expressing the SIR CD8SP-CLL1-M26-vL-[hTCRb-opt2]-F-P2A-SP-CLL1-M26-vH-[hTCRa-opt2]-F-F2A-PAC (012616-A05) [SEQ ID NO:4790] construct targeting CLL1 were selected with puromycin and tested against HL60-Gluc cells at an E:T ratio of 10:1 for 4 hours. Gluc cytotoxicity assay showed effective induction of target cell lysis by T cells expressing the (012616-A05) [SEQ ID NO:4790] SIR as compared to uninfected T cells or wells containing media alone.

T cells expressing SIRs against CLEC5A and CLL1 induce cytotoxicity in CLEC5A and CLL1-expressing HL60 cells. The experiment was repeated with T cells expressing SIRs against CLEC5A and CLL1. The results showed an effective induction of HL60-Gluc cell lysis by T cells expressing the CD8SP-V5-[hTCRb-KACIAH]-F-P2A-CD8SP-CLEC5A-8H8F5-vL-Gly-Ser-Linker-CLEC5A-8H8F5-vH-Myc-[hTCRa-CSDVP]-F-F2A-PAC (042816-E05) [SEQ ID NO:1666], CD8SP-CLL1-M26-vL-[hTCRb-opt2]-F-P2A-SP-CLL1-M26-vH-[hTCRa-opt2]-F-F2A-PAC (012616-A05) [SEQ ID NO:4790] and CD8SP-CLL1-M32-vL-V5-[hTCRb-KACIAH]-F-P2A-SP-CLL1-M32-vH-Myc-[hTCRa-CSDVP]-F-F2A-PAC (021216-I03) [SEQ ID NO: 1250] SIRs as compared to uninfected T cells or wells containing media alone. The Gluc values were nearly 9-fold, 4-fold, and 7-fold higher in the cells treated with the T cells expressing the three SIRs, respectively.

T cells expressing SIRs targeting CSF2RA, LAMP1 and CLL1 induce cytotoxicity in CSF2RA, LAMP1 and CLL1-expressing THP1 cells. T cells expressing different SIRs were cultured for 4 hours with THP-Gluc cells at an E:T ratio of 10:1 and tested using GLuc-cytotoxicity assay. The results showed an effective induction of target cell lysis by T cells expressing the CD8SP-V5-[hTCRb-KACIAH]-F-P2A-CD8SP-CSF2RA-Ab1-vL-Gly-Ser-Linker-CSF2RA-Ab1-vH-Myc-[hTCRa-CSDVP]-F-F2A-PAC (050216-B02) [SEQ ID NO:1676], CD8SP-V5-[hTCRb-KACIAH]-F-P2A-CD8SP-LAMP1-Mb4-vL-Gly-Ser-Linker-LAMP1-Mb4-vH-Myc-[hTCRa-CSDVP]-F-F2A-PAC (050216-F05) [SEQ ID NO: 1732] and CD8SP-CLL1-M32-vL-V5-[hTCRb-KACIAH]-F-P2A-SP-CLL1-M32-vH-Myc-[hTCRa-CSDVP]-F-F2A-PAC (021216-I03) [SEQ ID NO: 1250] SIRs targeting CSF2RA, LAMP1 and CLL1, respectively, as compared to uninfected T cells or wells containing media alone.

T cells expressing SIR targeting CSF2RA induce cytotoxicity in CSF2RA-expressing Molm13 cells. T cells expressing SIRs targeting CSF2RA were cultured for 4 hours with Molm13-Gluc cells at an E:T ratio of 10:1 and tested using GLuc-cytotoxicity assay. The results showed effective induction of target cell lysis by T cells expressing the SIR CD8SP-V5-[hTCRb-KACIAH]-F-P2A-CD8SP-CSF2RA-Ab1-vL-Gly-Ser-Linker-CSF2RA-Ab1-vH-Myc-[hTCRa-CSDVP]-F-F2A-PAC (050216-B02) [SEQ ID NO:1676] targeting CSF2RA as compared to uninfected T cells or T cells expressing SIR targeting KSHV protein (111815-O05) or wells containing media alone.

T cells expressing SIRs targeting TSHR (Thyroid Stimulating Hormone Receptor) and TnAg induce cytotoxicity in TSHR and TnAg-expressing Jurkat and PEER cells. T cells expressing different SIRs targeting TSHR and Tn Ag were cultured for 4 hours with Jurkat-Gluc and PEER1-Gluc cells at an E:T ratio of 10:1 and tested using GLuc-cytotoxicity assay. The results showed effective induction of target cell lysis by T cells expressing the SIRs CD8SP-V5-[hTCRb-KACIAH]-F-P2A-CD8SP-TSHR-KB1-vL-Gly-Ser-Linker-TSHR-KB1-vH-Myc-[hTCRa-CSDVP]-F-F2A-PAC (042916-E03) [SEQ ID NO:1795] and CD8SP-V5-[hTCRb-KACIAH]-F-P2A-CD8SP-TnAg-vL-Gly-Ser-Linker-TnAg-vH-Myc-[hTCRa-CSDVP]-F-F2A-PAC (050216-A04) [SEQ ID NO: 1788] targeting TSHR and TnAg, respectively, as compared to uninfected T cells, T cells expressing negative control SIRs (111815-O05, 042816-H07, 031516-J07) or wells containing media alone.

T cells expressing SIR targeting TnAg induce cytotoxicity in TnAg-expressing Jurkat and PEER cells. T cells expressing SIR targeting TnAg were cultured for 4 hours with Jurkat-Gluc and PEER1-GLuc cells at an E:T ratio of 10:1 and tested using GLuc-cytotoxicity assay. The results showed effective induction of target cell lysis by T cells expressing the SIR CD8SP-V5-[hTCRb-KACIAH]-F-P2A-CD8SP-TnAg-vL-Gly-Ser-Linker-TnAg-vH-Myc4-[preTCRa-Del48]-F-F2A-PAC (080816-H06) [SEQ ID NO:2003] targeting TnAg as compared to uninfected T cells or wells containing media alone.

T cells expressing SIR targeting MPL (TPO receptor) induce cytotoxicity in MPL-expressing cells. T cells expressing a SIR targeting MPL were cultured for 4 hours with HEL-Gluc cells at an E:T ratio of 10:1 and tested using GLuc-cytotoxicity assay. The experiment showed an effective induction of target cell lysis by T cells expressing the SIR CD8SP-MPL-175-vL-[hTCRb-opt2]-F-P2A-SP-175-vH-[hTCRa-opt2]-F-F2A-PAC (042116-G01) [SEQ ID NO: 4862] targeting MPL as compared to uninfected T cells or wells containing media alone.

T cells expressing SIR targeting FLT3 induce cytotoxicity in FLT3-expressing RS:411 (or RS411) cells. T cells expressing SIR targeting FLT3 were cultured for 4 hours with RS:411-Gluc cells at an E:T ratio of 10:1 and tested using GLuc-cytotoxicity assay. The data showed effective induction of target cell lysis by T cells expressing the SIR CD8SP-FLT3-NC7-vL-V5-[hTCRb-KACIAH]-F-P2A-SP-FLT3-NC7-vH-Myc-[hTCRa-CSDVP]-F-F2A-PAC (050316-C01) [SEQ ID NO:1273] targeting FLT3 as compared to uninfected T cells, T cells expressing negative control SIR (111815-O05) or wells containing media alone.

T cells expressing SIR expressing NKG2D extracellular domain and SIRs targeting FLT3 and CSF2RA induce cytotoxicity in MV411 target cells. Human peripheral blood T cells i expressing the extracellular domain of NKG2D (linked to the hTCR-CSDVP constant chain via a GGGGS-GGGGD-Myc linker) and those targeting FLT3 and CSF2RA were tested against MV411-Gluc cells s at an Effector:Target (E:T) ratio of 10:1 for 4 hours. The Gluc cytotoxicity assay showed effective induction of target cell lysis by T cells expressing the CD8SP-V5-[hTCRb-KACIAH]-F-P2A-CD8SP-NKG2D-(GGGGS-GGGGD)-Myc-[hTCRa-CSDVP]-F-F2A-PAC (042916-A06) [SEQ ID NO:1755] and CD8SP-FLT3-NC7-vL-V5-[hTCRb-KACIAH]-F-P2A-SP-FLT3-NC7-vH-Myc-[hTCRa-CSDVP]-F-F2A-PAC (050316-Cβ1) [SEQ ID NO:1273] and CD8SP-V5-[hTCRb-KACIAH]-F-P2A-CD8SP-CSF2RA-Ab1-vL-Gly-Ser-Linker-CSF2RA-Ab1-vH-Myc-[hTCRa-CSDVP]-F-F2A-PAC (050216-B02) [SEQ ID NO:1676] SIRs as compared to uninfected T cells, T cells expressing the control SIR CD8SP-KSHV-4C3-vL-V5-[hTCRb-S57C-opt]-F-P2A-SP-4C3-vH-Myc-[hTCRa-T48C-opt]-F-F2A-PAC (111815-O05) [SEQ ID NO: 4639] SIR or wells containing media alone. The above results demonstrate that a SIR in which the antigen binding domain is comprised of a receptor (i.e. NKG2D) is functionally active.

T cells expressing CD30 and WT1 SIRs induce cytotoxicity in U266 and L363 target cells. SIR can be generated against intracellular peptides that can be recognized in association with specific HLA antigens. Human peripheral blood T cells isolated using CD3 magnetic beads were infected with lentiviruses expressing the indicated SIR constructs targeting CD30 or WT1. The WT1 SIRs recognizes the peptide (RMFPNAPYL) derived from WT1 in conjunction with HLA-A2 molecule. Cells were selected with puromycin and expanded. U266 (WT1+/HLA-A2+) and L-363 (WT1+/HLA-A2+) cells stably expressing hGLuc were cocultured with T cells expressing the SIRs at an Effector:Target (E:T) ratio of 10:1 for 4 hours. \The Gluc cytotoxicity assay showed that while the T cells expressing the SIR CD8SP-WT1-Ab1-vL-V5-[hTCRb-S57C-opt]-F-P2A-SP-WT1-Ab1-vH-Myc-[hTCRa-T48C-opt]-F-F2A-PAC (012816-G01) [SEQ ID NO: 4709] were minimally effective, the T cells expressing the SIR CD8SP-WT1-Ab5-vL-V5-[hTCRb-S57C-opt]-F-P2A-SP-WT1-Ab5-vH-Myc-[hTCRa-T48C-opt]-F-F2A-PAC (111815-C04) [SEQ ID NO: 4710] effectively killed the target cells as compared to uninfected T cells (T-UI). Additionally, a SIR CD8SP-CD30-Ac10-vL-V5-[hTCRb-KACIAH]-F-P2A-SP-CD30-Ac10-vH-Myc-[hTCRa-CSDVP]-F-F2A-PAC (010716-K01) [SEQ ID NO:1227] that targets CD30 effectively killed the CD30 expressing target cells.

T cells expressing SIRs targeting CD33 and CD179b induce cytotoxicity in CD33 and CD179b expressing HL60 and Molm13 cells. T cells expressing SIR targeting CD33 and CD179b were cultured for 4 hours with HL60-Gluc and Molm13-Gluc cells at an E:T ratio of 10:1 and tested using GLuc-cytotoxicity assay. The data showed an effective induction of target cell lysis by T cells expressing the SIRs CD8SP-CD33-AF5-vL-V5-[TCRβ-KACIAH]-F-P2A-SP-CD33-AF5vH-MYC-[TCRa-CSDVP]-F-F2A-Pac (052416-K05) [SEQ ID NO: 1229] and CD179b-vL-V5-{TCRβ-KACIAH}-F-P2A-SP-CD179b-vH-MYC-[TCRa-CSDVP]-F-F2A-Pac (063016-Y06) [SEQ ID NO: 1237] targeting CD33 and CD179b, respectively, as compared to uninfected T cells or wells containing media alone.

T cells expressing SIRs targeting CD33 induce cytotoxicity in CD33 expressing HL60 cells. T cells expressing SIR targeting CD33 were cultured for 4 hours with HL60-Gluc cells at an E:T ratio of 10:1 and tested using GLuc-cytotoxicity assay. The experiment showed an effective induction of target cell lysis by T cells expressing the SIRs CD8SP-V5-[hTCRb-KACIAH]-F-P2A-CD8SP-CD33-huMyc9-vL-Gly-Ser-Linker-CD33-huMyc9-vH-Myc-[hTCRa-CSDVP]-F-F2A-PAC (090116-C02) [SEQ ID NO:1650] and CD8SP-V5-[hTCRb-KACIAH]-F-P2A-CD8SP-CD33-AF5-vL-Gly-Ser-Linker-CD33-AF5-vH-Myc4-[preTCRa-Del48]-F-F2A-PAC (083116-E02) [SEQ ID NO:1864] and CD8SP-V5-[hTCRb-KACIAH]-F-P2A-CD8SP-CD33-huMyc9-vL-Gly-Ser-Linker-CD33-huMyc9-vH-Myc4-[preTCRa-Del48]-F-F2A-PAC (083116-C06) [SEQ ID NO:1865] targeting CD33 as compared to uninfected T cells or wells containing media alone.

T cells expressing SIRs targeting CXCR4 induce cytotoxicity in CXCR4 expressing THP cells. Human peripheral blood T cells isolated using CD3 magnetic beads were infected with lentiviruses expressing the indicated bispecific SIR construct CD8SP-CXCR4-1-vHH-V5-[hTCRb-KACIAH]-F-P2A-SP-FMC63-vH-MYC-[hTCRa-CSDV]-F-F2A-PAC (101415-V01) [SEQ ID NO:1171] targeting CXCR4. The SIR construct also expressed vH fragment of the FMC63 antibody against CD19. Cells were cultured with HL60-GLuc cells at E:T ratio of 5:1 for 4 hours and cytotoxicity measured using Gluc assay. The experiment showed an effective induction of target cell lysis by T cells expressing the SIR targeting CXCR4 as compared to uninfected T cells or wells containing media alone.

T cells expressing SIR against IL11Ra induce cytotoxicity in IL11Ra-expressing BV173 cells. T cells expressing SIR targeting IL11Ra were cultured for 4 hours with THP1-Gluc cells at an E:T ratio of 10:1 and tested using GLuc-cytotoxicity assay. The results showed effective induction of Bv173 target cells lysis by T cells expressing the CD8SP-IL11Ra-8E2-Ts107-vL-V5-[hTCRb-KACIAH]-F-P2A-SP-IL11Ra-8E2-Ts107-vH-Myc-[hTCRa-CSDVP]-F-F2A-PAC (050516-R06) [SEQ ID NO:1304] SIR as compared to T-UI cells or medium alone.

T cells expressing CD16 SIRs induce cytotoxicity in CD20-expressing RAJI lymphoma in conjunction with CD20 monoclonal antibody Rituximab. Human peripheral blood T cells isolated using CD3 magnetic beads were infected with lentiviruses expressing the SIR construct CD8SP-V5-[hTCRb-KACIAH]-F-P2A-CD8SP2-CD16A-v158-v2-Myc-[hTCRa-T48C-opt]-F-F2A-PAC (020416-A08) [SEQ ID NO:1186 expressing CD16A variant v158A which has high affinity for human IgG. A 4C3 SIR against a KSHV protein was used as a negative control. Cells were selected with puromycin and expanded. RAJI cells stably expressing hGLuc were cocultured with T cells expressing the SIRs at an Effector:Target (E:T) ratio of 10:1 for 4 hours in the absence and presence of rituximab (1 µg/ml). SIR-T cells mediated induction of lysis of target cells was assayed by increase of GLuc activity as measured by BioTek synergy plate reader by directly injecting 0.5×CTZ assay buffer containing native coeloentrazine (Nanaolight). The results show effective target cell lysis by CD16A-v158 SIR construct but only in the presence of rituximab. Thus, the CD16A v158 SIR can act as a universal SIR which can be used with any monoclonal antibody thereby obviating the need to make individual SIR against different antigen targets.

T cells expressing CD123-161 bispecific SIRs induce cytotoxicity in MPL-expressing Bv173 and HEL cells. Human peripheral blood T cells isolated using CD3 magnetic beads were infected with lentiviruses expressing the IgHSP-CD123-2-vHH-V5-[hTCRb-S57C-opt]-F-P2A-CD8SP-MPL-161-HL-Myc-[hTCRa-T48C-opt]-F-F2A-PAC (022516-M08) [SEQ ID NO: 4591] SIR construct targeting both CD123 and MPL (161). Cells were selected with puromycin and expanded. Bv173 and HEL target cells stably expressing hGLuc were cocultured with T cells expressing the SIRs at an Effector:Target (E:T) ratio of 10:1 for 4 hours. Gluc cytotoxicity assay showed that a bispecific SIR can induce effective lysis of the target cells expressing its target antigen or antigens.

T cells expressing SIR against CD123 induce cytotoxicity in CD123-expressing L428 cells. T cells expressing SIR targeting CD123 were cultured for 4 hours with L428-Gluc cells at an E:T ratio of 10:1 and tested using GLuc-cytotoxicity assay. The experiment showed an effective induction of the L428 target cells lysis by T cells expressing the CD8SP-CD123-CSL362-vL-V5-[hTCRb-KACIAH]-F-P2A-SP-CD123-CSL362-vH-Myc-[preTCRa-Del48]-F-F2A-PAC (041416-K04) [SEQ ID NO:1445] SIR as compared to T-UI cells or medium alone.

T cells expressing SIR against CD123 induce cytotoxicity in CD123-expressing Bv173 cells. T cells expressing SIR targeting CD123 were cultured for 4 hours with Bv173-Gluc cells at an E:T ratio of 10:1 and tested using GLuc-cytotoxicity assay. The result shows effective induction of the Bv173 target cells lysis by T cells expressing the IgHSP-CD123-2-vHH-V5-[hTCRb-KACIAH]-F-P2A-SP-CD123-1-vHH-Myc-[preTCRa-Del48]-F-F2A-PAC (041416-V03) [SEQ ID NO:1467] SIR as compared to T-UI cells or medium alone (Med). This SIR contains two different camelid vHH (CD123-2 and CD123-1) attached to hTCRb-KACIAH and preTCRa-Del48 constant chain fragments, respectively. These results demonstrate that SIR containing two different antigen binding domains are functionally active.

T cells expressing SIRs targeting CD79b and CD138 induce cytotoxicity in CD79b and CD138 expressing RAJI and L363 cells. T cells expressing SIR targeting CD79b and CD138 were cultured for 4 hours with RAJI-Gluc and L363-Gluc cells at an E:T ratio of 10:1 and tested using GLuc-cytotoxicity assay. The results show effective induction of target cells lysis by T cells expressing the CD8SP-CD79b-2F2-vL-V5-[hTCRb-S57C-opt]-F-P2A-SP-CD79b-2F2-vH-Myc-[preTCRa-Del48]-F-F2A-PAC (041216-H05) [SEQ ID NO:1130] and CD8SP-CD138-vL-V5-[hTCRb-KACIAH]-F-P2A-SP-CD138-vH-Myc-[preTCRa-Del48]-F-F2A-PAC (041416-I03) [SEQ ID NO:1446] SIRs targeting CD79b and CD138, respectively, as compared to uninfected T cells or wells containing media alone.

T cells expressing TCRβ1 SIRs induce cytotoxicity in TCRβ1-expressing Jurkat cells. Human peripheral blood T cells isolated using CD3 magnetic beads were infected with lentiviruses expressing the CD8SP-V5-[hTCRb-KACIAH]-F-P2A-CD8SP-TCRB1-CP01-E09-vL-Gly-Ser-Linker-TCRB1-CP01-E09-vH-Myc-[hTCRa-CSDVP]-F-F2A-PAC (030816-D04) [SEQ ID NO:1778] and CD8SP-V5-[hTCRb-KACIAH]-F-P2A-CD8SP-TCRB1-Jovi1-vL-Gly-Ser-Linker-TCRB1-Jovi1-vH-Myc-[hTCRa-CSDVP]-F-F2A-PAC (030816-B07) [SEQ ID NO:1779] SIR constructs targeting TCRB1 (TCRβ1) constant chain and CD8SP-CD30-Ac10-vL-V5-[hTCRb-KACIAH]-F-P2A-SP-CD30-Ac10-vH-Myc-[hTCRa-CSDVP]-F-F2A-PAC (063016-K02) [SEQ ID NO:1227] SIR targeting CD30. Cells were selected with puromycin and expanded. Jurkat cells stably expressing hGLuc were cocultured with T cells expressing the SIRs at an Effector:Target (E:T) ratio of 10:1 for 4 hours. SIR-T cells mediated induction of lysis of target cells was assayed by increase of GLuc activity. The results show that CD8SP-V5-[hTCRb-KACIAH]-F-P2A-CD8SP-TCRB1-Jovi1-vL-Gly-Ser-Linker-TCRB1-Jovi1-vH-Myc-[hTCRa-CSDVP]-F-F2A-PAC (030816-B07) [SEQ ID NO:1779] and CD8SP-CD30-Ac10-vL-V5-[hTCRb-KACIAH]-F-P2A-SP-CD30-Ac10-vH-Myc-[hTCRa-CSDVP]-F-F2A-PAC (063016-K02) [SEQ ID NO:1227] induced effective target cell lysis whereas the CD8SP-V5-[hTCRb-KACIAH]-F-P2A-CD8SP-TCRB1-CP01-E09-vL-Gly-Ser-Linker-TCRB1-CP01-E09-vH-Myc-[hTCRa-CSDVP]-F-F2A-PAC (030816-D04) [SEQ ID NO:1778] was not as effective.

T cells expressing TCRβ2 SIRs induce cytotoxicity in Jurkat cells expressing a TCRβ2 constant chain containing SIR. In initial experiments, T cells expressing SIRs directed against TCRβ2 chain were functionally inactive in cellular cytotoxicity assay. It was reasoned that this could be due to the fact that the TCRβ constant chain in these SIRs was derived from TCRβ2 chain and therefore such SIR-expressing T cells would have committed suicide or fratricide (i.e. killed off neighboring SIR-expressing T cells). To circumvent this problem SIRs targeting TCRβ2 were generated using TCRβ1-opt4 constant chain (nucleic acid SEQ ID NO: 752 and amino acid SEQ ID NO: 3032) which is based on TCRB1 chain. Human peripheral blood T cells isolated using CD3 magnetic beads were infected with lentiviruses expressing the indicated SIR (CD8SP-TCRB2-D05-vL-[hTCRb-opt4]-F-P2A-SP-TCRB2-D05-vH-MYC-[hTCRa-CSDVP]-F-F2A-Pac-K06 (072816-K06) [SEQ ID NO: 1129] and CD8SP-TCRB2-CP01-E05-vL-[hTCRb-opt4]-F-P2A-SP-TCRB2-CP01-E05-vH-Myc-[hTCRa-CSDVP]-F-F2A-PAC (072816-L06) [SEQ ID NO:1128]) constructs targeting TCRB2 (TCRβ2) constant chain. Cells were selected with puromycin and expanded. For target cell line, we used Jurkat cells stably expressing a TCRB2 constant chain containing SIR targeting PSMA. The Jurkat cells also coexpressed a signal peptide-deficient version of TurboLuc as a reporter. The Jurkat cells were cocultured with T cells expressing the SIRs at an Effector:Target (E:T) ratio of 10:1 for 4 hours. SIR-T cells mediated induction of lysis of target cells was assayed by increase of TurboLuc activity as measured by BioTek synergy plate reader by directly injecting 0.5×CTZ assay buffer containing native coeloentrazine (Nanaolight). The results show T cells expressing both CD8SP-TCRB2-D05-vL-[TCRb-opt4]-F-P2A-SP-TCRB2-D05-vH-MYC-[TCRa-CSDVP]-F-F2A-Pac-K06 (072816-K06) [SEQ ID NO: 1129] and CD8SP-TCRB2-CP01-E05-vL-[hTCRb-opt4]-F-P2A-SP-TCRB2-CP01-E05-vH-Myc-[hTCRa-CSDVP]-F-F2A-PAC (072816-L06) [SEQ ID NO:1128] SIRs induced effective lysis of the target cells as shown by increase in TurboLuc activity when compared to uninfected T cells (T-UI) or media alone.

T cells expressing Folate Receptor 1 (FR1) SIRs induce cytotoxicity in FR1-expressing SKOV3, PC3 and LNCAP cells. Human peripheral blood T cells isolated using CD3 magnetic beads were infected with lentiviruses expressing the indicated SIR construct (CD8SP-FR1-huMov19-vL-V5-[hTCRb-KACIAH]-F-P2A-SP-FR1-huMov19-vH-Myc-[hTCRa-CSDVP]-F-F2A-PAC (102915-P07) [SEQ ID NO:1276]) targeting FR1. Cells were selected with puromycin and expanded. SKOV3, PC3 and LNCAP cells stably expressing hGLuc were cocultured with T cells expressing the SIRs at an Effector:Target (E:T) ratio of 10:1 for 4 hours. SIR-T cells mediated induction of lysis of target cells was assayed by increase of GLuc activity. Results show effective induction of SKOV3 and PC3 cell death by T cells expressing the CD8SP-FR1-huMov19-vL-V5-[hTCRb-KACIAH]-F-P2A-SP-FR1-huMov19-vH-Myc-[hTCRa-CSDVP]-F-F2A-PAC (102915-P07) [SEQ ID NO:1276] SIRs as compared to uninfected T cells (T-UI). T cells expressing SIRs targeting Epcam1 and L1CAM also showed weak induction of cell death as compared to uninfected T cells in SKOV3 and PC3 cell lines.

T cells expressing SIRs against intracellular antigens TERT, MART1, MUC1, gp100, tyrosinase and NYESO induce cytotoxicity in target cells. Human peripheral blood T cells isolated using CD3 magnetic beads were infected with lentiviruses expressing the indicated SIR constructs (CD8SP-V5-[hTCRb-KACIAH]-F-P2A-CD8SP-TERT-3G3-T865-vL-Gly-Ser-Linker-TERT-3G3-T865-vH-Myc-[hTCRa-CSDVP]-F-F2A-PAC (021216-L07) [SEQ ID NO:1784], CD8SP-TERT-3G3-T865-vL-[hTCRb-opt2]-F-P2A-SP-TERT-3G3-T865-vH-[hTCRa-opt2]-F-F2A-PAC (050316-A01) [SEQ ID NO:4902], CD8SP-V5-[hTCRb-KACIAH]-F-P2A-CD8SP-MART1-CAG10-vL-Gly-Ser-Linker-MART1-CAG10-vH-Myc-[hTCRa-CSDVP]-F-F2A-PAC (021216-N03) [SEQ ID NO:1739], CD8SP-V5-[hTCRb-KACIAH]-F-P2A-CD8SP-Muc1-D6-M3B8-vL-Gly-Ser-Linker-Muc1-D6-M3B8-vH-Myc-[hTCRa-CSDVP]-F-F2A-PAC (021616-B05) [SEQ ID NO:1751], CD8SP-MUC1-D6-M3A1-vL-[hTCRb-opt2]-F-P2A-SP-MUC1-D6-M3A1-vH-[hTCRa-opt2]-F-F2A-PAC (050316-B01) [SEQ ID NO:4870], CD8SP-NYESO-T1-vL-[hTCRb-opt2]-F-P2A-SP-NYESO-T2-vH-[hTCRa-opt2]-F-F2A-PAC (040416-D01) [SEQ ID NO:4877], CD8SP-gp100-vL-[hTCRb-opt2]-F-P2A-SP-gp100-vH-[hTCRa-opt2]-F-F2A-PAC (031516-B03) [SEQ ID NO:4828], and CD8SP-Tyros-B2-vL-[hTCRb-opt2]-F-P2A-SP-Tyros-B2-vH-[hTCRa-opt2]-F-F2A-PAC (032816-B03) [SEQ ID NO:4915]. The SIRs targeting TERT, MART1, MUC1, gp100, tyrosinase and NYESO recognize peptides derived from these intracellular proteins in conjunction with HLA-A2 molecule as described previously. Cells were selected with puromycin and expanded. The indicated target (HLA-A2) cells stably expressing hGLuc were cocultured with T cells expressing the SIRs at an Effector:Target (E:T) ratio of 10:1 for 4 hours. SIR-T cells mediated induction of lysis of target cells was assayed by increase of GLuc activity. Results show that SIRs targeting TERT, MART1, MUC1, gp100, tyrosinase and NYESO show lysis of the HLA-A2 positive target cell lines expressing these intracellular antigens. In addition, T cells expressing the SIR CD8SP-V5-[hTCRb-KACIAH]-F-P2A-CD8SP-GD3-KM-641-vL-Gly-Ser-Linker-GD3-KM-641-vH-Myc-[hTCRa-CSDVP]-F-F2A-PAC (042816-A04) [SEQ ID NO:1697] targeting GD3 showed lysis of MEL624 target cells expressing GD3.

T cells expressing SIR against EGFR induce cytotoxicity in EGFR-expressing HeLa cells. Human peripheral blood T cells were infected with lentiviruses expressing a SIR construct targeting EGFR. Cells were selected with puromycin and expanded. HeLa cells stably expressing hGLuc were cocultured with T cells expressing the SIR or uninfected T cells (T-UI) at an Effector:Target (E:T) ratio of 5:1 for 24 hours. SIR-T cells mediated induction of lysis of target cells was assayed by increase of GLuc activity. The results showed effective induction of the HeLa target cells lysis by T cells expressing the CD8SP-V5-[hTCRb-KACIAH]-F-P2A-CD8SP-Cetuximab-vL-Gly-Ser-Linker-Cetuximab-vH-Myc4-[preTCRa-Del48]-F-F2A-PAC (062916-G04) [SEQ ID NO:1880] SIR as compared to T-UI cells or medium alone.

T cells expressing SIR against CD324 induce cytotoxicity in CD324-expressing MDA-MB-231 cells. Human peripheral blood T cells isolated were infected with lentiviruses expressing the indicated SIR construct targeting CD324. Cells were selected with puromycin and expanded. MDA-MB-231 cells stably expressing hGLuc were cocultured with T cells expressing the SIR or uninfected T cells (T-UI) at an Effector:Target (E:T) ratio of 5:1 for 24 hours. SIR-T cells mediated induction of lysis of target cells was assayed by increase of GLuc activity. The data showed effective induction of the CD324 target cells lysis by T cells expressing the CD8SP-CD324-SC10-6-vL-V5-[hTCRb-KACIAH]-F-P2A-SP-CD324-SC10-6-vH-Myc4-[hTCRa-CSDVP]-F-F2A-PAC (071516-L04) [SEQ ID NO:1239] SIR as compared to T-UI cells or medium alone.

T cells expressing SIR targeting CD276 and IL13Ra2 induce cytotoxicity in U87-MG target cells expressing these antigens. T cells were infected with lentiviruses expressing the SIR construct targeting CD276 and IL13Ra2. Cells were selected with puromycin and expanded. U87-MG-GLuc cells were cocultured with T cells expressing the SIR or uninfected T cells (T-UI) at an E:T ratio of 10:1 for 4 hours. SIR-T cells mediated induction of lysis of target cells was assayed by increase of GLuc activity. The data showed effective induction of target cell lysis by T cells expressing the CD8SP-V5-[hTCRb-KACIAH]-F-P2A-CD8SP-CD276-17-vL-Gly-Ser-Linker-CD276-17-vH-Myc-[hTCRa-CSDVP]-F-F2A-PAC (042816-C03) [SEQ ID NO:1658] SIR as compared to T-UI cells or medium alone.

T cells expressing SIR targeting GD2 induce cytotoxicity in SKMEL-31 and SKMEL-37 target cells expressing these antigens. T cells were infected with lentiviruses expressing the SIR construct targeting GD2. Cells were selected with puromycin and expanded. SKMEL-31 and SKMEL-37 cells stably expressing GLuc were cocultured with T cells expressing the SIR or uninfected T cells (T-UI) at an E:T ratio of 10:1 for 4 hours. SIR-T cells mediated induction of lysis of target cells was assayed by increase of GLuc activity. The data showed effective induction of target cell lysis by T cells expressing the CD8SP-GD2-hu3F8-vL-V5-[hTCRb-KACIAH]-F-P2A-SP-GD2-hu3F8-vH-Myc-[preTCRa-Del48]-F-F2A-PAC (041816-E01) [SEQ ID NO:1489] SIR as compared to T-UI cells or medium alone.

T cells expressing SIR against L1CAM induce cytotoxicity in L1CAM-expressing SKOV3 cells. T cells expressing SIR targeting L1CAM were cultured for 24 hours with SKOV3-GLuc cells at an E:T ratio of 10:1 and tested using GLuc-cytotoxicity assay. The data showed effective induction of the SKOV3 target cells lysis by T cells expressing the CD8SP-MYC-[hTCRa-T48C-opt1]-F-F2A-CD8SP-L1CAM-9-3-Hu3-V5-[hTCRb-T57C-opt1]-F-P2A-PAC (080316-T02) [SEQ ID NO:1136] SIR as compared to T-UI cells or medium alone.

T cells expressing SIR against CDH6 induce cytotoxicity in CDH6-expressing SKOV3 cells. T cells expressing SIRs targeting CDH6 were cultured for 24 hours with SKOV3-Gluc cells at an E:T ratio of 10:1 and tested using GLuc-cytotoxicity assay. The data showed effective induction of SKOV3 target cells lysis by T cells expressing the CD8SP-CDH6-NOV712-vL-V5-[hTCRb-KACIAH]-F-P2A-SP-CDH6-NOV712-vH-Myc-[hTCRa-CSDVP]-F-F2A-PAC (062816-U01) [SEQ ID NO:1242] and CD8SP-CDH6-NOV710-vL-V5-[hTCRb-KACIAH]-F-P2A-SP-CDH6-NOV710-vH-Myc-[hTCRa-CSDVP]-F-F2A-PAC (063016-T05) [SEQ ID NO:1241] SIRs as compared to T-UI cells or medium alone.

T cells expressing SIR against TROP2 induce cytotoxicity in TROP2-expressing PC3 cells. T cells expressing SIR targeting TROP2 were cultured for 24 hours with PC3-Gluc cells at an E:T ratio of 10:1 and tested using GLuc-cytotoxicity assay. The data showed effective induction of PC3 target cells lysis by T cells expressing the CD8SP-TROP2-ARA47-HV3KV3-vL-V5-[hTCRb-KACIAH]-F-P2A-SP-TROP2-ARA47-HV3KV3-vH-Myc-[hTCRa-CSDVP]-F-F2A-PAC (062816-S01) [SEQ ID NO:1367] SIR as compared to T-UI cells or medium alone.

T cells expressing SIR against GFRA4 (GDNF family receptor alpha 4) induce cytotoxicity in GFRA4-expressing TT cells. T cells expressing SIR targeting GFRA4 were cultured for 24 hours with TT-Gluc cells at an E:T ratio of 10:1 and tested using GLuc-cytotoxicity assay. The data showed effective induction of TT target cells lysis by T cells expressing the CD8SP-GFRa4-P4-10-vL-V5-[hTCRb-KACIAH]-F-P2A-SP-GFRa4-P4-10-vH-Myc-[hTCRa-CSDVP]-F-F2A-PAC (062816-W05) [SEQ ID NO:1282] SIR as compared to T-UI cells or medium alone.

T cells expressing SIR against MPL (Thrombopoietin Receptor) induce cytotoxicity in MPL-expressing HEL-92.1.7 cells. T cells expressing SIR targeting MPL were cultured for 4 hours with HEL-92.1.7-Gluc cells at an E:T ratio of 10:1 and tested using GLuc-cytotoxicity assay. The results showed effective induction of HEL-92.1.7 target cells lysis by T cells expressing the CD8SP-MPL-161-vL-V5-[hTCRb-S57C-opt1]-F-P2A-MPL-161-vH-Myc-[hTCRa-T48C-opt1]-F-F2A-PAC (040315-U02) [SEQ ID NO:1112] SIR as compared to T-UI cells or T cells expressing the CD8SP-FMC63-vL-V5-[TCRb-S57C-opt1]-F-P2A-SP-FMC63-vH-Myc-[TCRa-T48C-opt1]-F-F2A-PAC (050515-L05) [SEQ ID NO:900] SIR or medium alone.

T cells expressing SIR against MPL (Thrombopoietin Receptor) induce cytotoxicity in MPL-expressing HEL-92.1.7 cells. T cells expressing SIR targeting MPL were cultured for 4 hours with HEL-92.1.7-Gluc cells at an E:T ratio of 10:1 and tested using GLuc-cytotoxicity assay. The results showed effective induction of HEL-92.1.7 target cells lysis by T cells expressing the CD8SP-MPL-161-vL-V5-[hTCRb-S57C-opt1]-F-P2A-MPL-161-vH-Myc-[hTCRa-T48C-opt1]-F-F2A-PAC (040315-U02) [SEQ ID NO:1112] SIR as compared to T-UI cells or T cells expressing the CD8SP-FMC63(vL-vH)-Myc-BBz-T2A-PAC (112014-A13) [SEQ ID NO:4501] CAR or medium alone. Induction of target cell lysis was also observed when T cells expressing the single chain SIRs, CD8SP-MPL-161-vL-Ser-Gly-Linker-MPL-161-vH-Myc-[hTCRa-T48C-opt1]-F-T2A-PAC (040915-X03) [SEQ ID NO:1192] and CD8SP-MPL-161-vL-Ser-Gly-Linker-MPL-161-vH-V5-[hTCRb-S57C-opt1]-T2A-PAC (032415-E07) [SEQ ID NO:1193] were co-cultured with HEL-92.1.7 target cells. Finally, T cells expressing the single chain SIR CD8SP-MPL-161-vL-Ser-Gly-Linker-MPL-161-vH-Myc-[hTCRa-T48C-opt1]-F-T2A-PAC (040915-X03) [SEQ ID NO:1192] induced lysis of Jurkat-MPL cells. Other exemplary single chain SIRs in which the different scFv of the disclosure are attached to a mutant TCRα chain are represented by DNA SEQ ID NOs: 7519 to 7715 and 16694 to 16809 and PRT SEQ ID NOs: 8161 to 8357 and 16928 to 17043. These single chain SIRs are expressed without the complementary exogenous TCRβ chain preferably in cells in which the expression of endogenous TCRα chain has been reduced or eliminated. The single chain SIRs in which the different scFv of the disclosure are attached to a mutant TCRβ chain are represented by DNA SEQ ID NOs: 7733 to 7929 and 16811 to 16926 and PRT SEQ ID NOs: 8375 to 8571 and 17045 to 17160. These single chain SIRs are expressed without the complementary exogenous TCRα chain preferably in cells in which the expression of endogenous TCRβ1 and TCRβ2 chains have been reduced or eliminated.

T cells expressing SIR against TSLPR (Thymic stromal lymphopoietin Receptor) induce cytotoxicity in TSLPR-expressing Jurkat cells. T cells expressing SIR targeting TSLPR were cultured for 24 hours with Jurkat-Gluc cells at an E:T ratio of 10:1 and tested using GLuc-cytotoxicity assay. The data showed effective induction of Jurkat target cells lysis by T cells expressing the CD8SP-V5-[hTCRb-KACIAH]-F-P2A-CD8SP-TSLPR-vL-Gly-Ser-Linker-TSLPR-vH-Myc-[hTCRa-CSDVP]-F-F2A-PAC (091216-C03) [SEQ ID NO:1797] SIR as compared to T-UI cells or medium alone.

T cells expressing SIR against SSEA4 induce cytotoxicity in SSEA4-expressing P19 and F9 embryonal carcinoma cells. T cells expressing SIR targeting SSEA4 were cultured for 24 hours with HEL-92.1.7-Gluc cells at an E:T ratio of 10:1 and tested using GLuc-cytotoxicity assay. The results showed effective induction of SSEA4 target cells lysis by T cells expressing the CD8SP-V5-[hTCRb-KACIAH]-F-P2A-CD8SP-SSEA4-vL-Gly-Ser-Linker-SSEA4-vH-Myc-[hTCRa-CSDVP]-F-F2A-PAC (091516-I06) [SEQ ID NO:1776] and CD8SP-V5-[hTCRb-KACIAH]-F-P2A-CD8SP-SSEA4-vL-Gly-Ser-Linker-SSEA4-vH-Myc4-[preTCRa-Del48]-F-F2A-PAC (091516-K06) [SEQ ID NO:1991] SIR as compared to T-UI cells.

T cells expressing SIR against CDH17 induce cytotoxicity in CDH17-expressing LoVo cells. T cells expressing SIR targeting CDH7 were cultured for 24 hours with LoVo-Gluc cells at an E:T ratio of 10:1 and tested using GLuc-cytotoxicity assay. The results showed effective induction of LoVo target cells lysis by T cells expressing the CD8SP-CDH17-PTA001A4-vL-V5-[hTCRb-KACIAH]-F-P2A-SP-CDH17-PTA001A4-vH-Myc-[hTCRa-CSDVP]-F-F2A-PAC (062816-X02) [SEQ ID NO:1243] SIR as compared to T-UI cells or medium alone.

T cells expressing SIR against Mesothelin induce cytotoxicity in Mesothelin-expressing SKOV3 ovarian cancer cells. T cells expressing SIR targeting Mesothelin were cultured for 24 hours with SKOV3-Gluc cells at an E:T ratio of 10:1 and tested using GLuc-cytotoxicity assay. The data showed effective induction of SKOV3 target cells lysis by T cells expressing the CD8SP-V5-[hTCRb-KACIAH]-F-P2A-CD8SP-Mesothelin-m912-vL-Gly-Ser-Linker-m912-vH-Myc4-[preTCRa-Del48]-F-F2A-PAC (090616-E04) [SEQ ID NO:1956] SIR as compared to T-UI cells or medium alone.

T cells expressing SIR against FSHR (Follicular Stimulating Hormone Receptor) induce cytotoxicity in FSHR-expressing MDAMB-231 human breast cancer cells. T cells were infected with lentiviruses expressing a SIR construct targeting FSHR. The antigen binding domain of the SIR comprises the FSHb (Follicular Stimulating Hormone beta chain) chain joined via a Gly-Ser linker to the CGHa (Chorionic Gondatropin Hormone alpha chain) chain. Cells were selected with puromycin and expanded. MDAMB-231 cells stably expressing hGLuc were cocultured with T cells expressing the SIR or uninfected T cells (T-UI) at an Effector:Target (E:T) ratio of 10:1 for 24 hours. SIR-T cells mediated induction of lysis of target cells was assayed by increase of GLuc activity. The results showed effective induction of MDAMB-231 target cells lysis by T cells expressing the CD8SP-V5-[hTCRb-KACIAH]-F-P2A-CD8SP-FSHb-Gly-Ser-Linker-CGHa-Myc4-[preTCRa-Del48]-F-F2A-PAC (091516-N06) [SEQ ID NO:1909] SIR as compared to T-UI cells or medium alone. The results further demonstrate that a SIR in which the antigen binding domain comprises of heterodimeric cytokines are functionally active.

T cells expressing SIR against LHR (Luitenizing Hormone Receptor) induce cytotoxicity in LHR-expressing MCF7 human breast cancer cells. T cells were infected with lentiviruses expressing a SIR construct targeting LHR. The antigen binding domain of this SIR comprises the LHb (Luitenizing Hormone beta chain) chain joined via a Gly-Ser linker to the CGHa (Chorionic Gondatropin Hormone alpha chain) chain. Cells were selected with puromycin and expanded. MCF7 cells stably expressing hGLuc were cocultured with T cells expressing the SIR or uninfected T cells (T-UI) at an Effector:Target (E:T) ratio of 2:1 for 24 hours. SIR-T cells mediated induction of lysis of target cells was assayed by increase of GLuc activity. The results showed modest induction of MDAMB-231 target cells lysis by T cells expressing the CD8SP-V5-[hTCRb-KACIAH]-F-P2A-SP-LHb-Gly-Ser-Linker-CGHa-Myc-[hTCRa-CSDVP]-F-F2A-PAC (091616-R03) [SEQ ID NO:1735] SIR as compared to T-UI cells or medium alone. The results further demonstrate that a SIR in which the antigen binding domain comprises of heterodimeric cytokines are functionally active.

T cells expressing SIR against DLL3 (Delta-like 3) induces cytotoxicity in DLL3-expressing SKMEL31 and SKMEL37 melanoma cells. T cells expressing SIR targeting DLL3 were cultured for 24 hours with SKMEL31-Gluc and SKMEL37-GLuc cells at an E:T ratio of 10:1 and tested using GLuc-cytotoxicity assay. The data showed effective induction of SKMEL31 and SKMEL37 target cells lysis by T cells expressing the CD8SP-DLL3-hSC16-13-vL-V5-[hTCRb-KACIAH]-F-P2A-SP-DLL3-hSC16-13-vH-Myc4-[hTCRa-CSDVP]-F-F2A-PAC (071516-N04) [SEQ ID NO:1263] SIR as compared to T-UI cells or medium alone.

T cells expressing SIR against EGFRvIII mutant induces cytotoxicity in EGFRvII-expressing HeLa cells. Human peripheral blood T cells isolated using CD3 magnetic beads were infected with lentiviruses expressing a SIR construct targeting EGFRvIII. Cells were selected with puromycin and expanded. HeLa cells were engineered to express EGFRvIII and hGLuc by infection with a retroviral vector (MSCV-EGFRvIII) and a retroviral vector expressing hGLuc. The Hela-EGFRvIII-hGluc cells were cocultured with T cells expressing the SIR or uninfected T cells (T-UI) at an Effector:Target (E:T) ratio of 2:1 for 24 hours. SIR-T cells mediated induction of lysis of target cells was assayed by increase of GLuc activity. The experiment showed induction of target cells lysis by T cells expressing the CD8SP-V5-[hTCRb-KACIAH]-F-P2A-CD8SP-EGFRvIII-2173-vH-Gly-Ser-Linker-EGFRvIII-2173-vH-Myc4-[preTCRa-Del48]-F-F2A-PAC (090616-D03) [SEQ ID NO:1902] SIR as compared to T-UI cells or medium alone.

T cells expressing SIR against EGFR induces cytotoxicity in EGFR-expressing HeLa cells.=T cells expressing SIR targeting EGFR were cultured for 24 hours with Hela-Gluc cells at an E:T ratio of 2:1 and tested using GLuc-cytotoxicity assay. The data showed induction of EGFR target cells lysis by T cells expressing the CD8SP-Cetuximab-vL-V5-[hTCRb-KACIAH]-F-P2A-SP-Cetuximab-vH-Myc4-[hTCRa-CSDVP]-F-F2A-PAC (071516-H04) [SEQ ID NO:1245] SIR as compared to T-UI cells or medium alone.

T cells expressing SIR against HIV1-envelop glycoprotein induces cytotoxicity in HIV1-envelop glycoprotein expressing HL2/3 cells. Human peripheral blood T cells isolated using CD3 magnetic beads were infected with lentiviruses expressing the indicated SIR construct targeting HIV1-envelop glycoprotein. Cells were selected with puromycin and expanded. HL2/3 cells which express HIV1 envelop glycoprotein and were engineered to stably express hGLuc were cocultured with T cells expressing the SIR or uninfected T cells (T-UI) at an Effector:Target (E:T) ratio of 2:1 for 24 hours. SIR-T cells mediated induction of lysis of target cells was assayed by increase of GLuc activity. The results showed induction of HIV1 envelop target cells lysis by T cells expressing the CD8SP-HIV1-3BNC117-vL-MYC2-[hTCRb-KACIAH]-F-P2A-SP-HIV1-3BNC117-vH-Myc4-[hTCRa-CSDVP]-F-F2A-PAC (091616-Y01-RP) [SEQ ID NO:1297] SIR as compared to T-UI cells or medium alone.

SIR targeting BST1/CD157 exert cytotoxicity against Molm13 leukemia cells. T cells are engineered to express the SIRs with SEQ ID NOs: 11333 to 11335 targeting BST1 and tested for cytotoxicity against Molm13-Gluc cells following 24 hour co-culture at an E:T ratio of 10:1. Cytotoxicity is measured by Gluc assay. BST1-targeting SIR-T cells are show to result in significant cell death as measured by increase in GLuc activity.

SIRs targeting IL1RAP exert cytotoxicity against Molm13 leukemia cells. T cells are engineered to express the SIRs with SEQ ID NOs: 18242, 18248 and 18254 targeting IL1RAP and tested for cytotoxicity against Molm13-Gluc cells following 24 hour co-culture at an E:T ratio of 10:1. Cytotoxicity is measured by Gluc assay. IL1RAP-targeting SIR-T cells are show to result in significant cell death as measured by increase in GLuc activity.

SIR-TREG cells block cytotoxic activity of SIR-T cells. T-Reg cells were isolated using T-Reg isolation kit (130-091-301) from Miltenyi and following the manufacturer's recommendations. T-Reg cells were cultured in T cell culture medium supplemented with Rapamycin 100 ng/ml T. Total T cells and T-Reg cells were infected with the indicated CAR and SIR lentiviruses. Cells were selected with puromycin 400 ng/ml. The T and T-Reg cells expressing the CAR and SIR targeting CD19 were cocultured for 4 hours with RAJI-Gluc cells either alone or in combination at an E:T ratio of 10:1 and cytotoxicity measured by directly injecting 0.5×CTZ assay buffer containing native coeloentrazine (Nanaolight). The results show that T-Reg cells expressing SIR targeting CD19 can partially block the cytotoxic activity of T cells expressing the SIR.

Jurkat NFAT-GFP Assay For Synthetic Immune Receptors. The Jurkat-NFAT-GFP cells are engineered in such a way that the IL-2 promoter, which carries NFAT binding sites, is cloned upstream of the GFP gene. These cells have been used to study signaling via TCR and CAR. The different SIRs were stably expressed in Jurkat NFAT-GFP cells by lentiviral mediated gene transfer, followed by selection with puromycin. The SIR-expressing Jurkat-NFAT-GFP cells were cocultured with the target cells at E:T ratio of approximately 1:2 for approximately 4 hours to 18 hours. When the interaction between SIRs and their target antigen results in activation of the NFAT pathway, GFP expression is induced. Hence Jurkat-NFAT-GFP cells expressing SIR show increased levels of GFP expression when they interact with target cell lines expressing the receptor for the SIR.

Induction of GFP expression by coculturing of Jurkat-NFAT-GFP cells expressing different SIR constructs and the different target cells was studied essentially as described previously (Wu, Roybal, Puchner, Onuffer, & Lim, 2015). GFP expression was monitored by FACS analysis. A few representative examples of this assay are shown in the FIG. 13A-B. In panel A, control Jurkat-NFAT-GFP cells or those expressing SIRs targeting CD19 (clone ID 051716-I08), MPL (Clone ID: 040716-A07) and BCMA (Clone ID: 011116-A07) were incubated with RAJI (top), HEL (middle) or U266 (bottom) cells, respectively. Induction of GFP expression is evident upon coculture of SIR-expressing Jurkat-NFAT-GFP cells with their respective target cells. In panel B, Jurkat cells expressing SIR targeting CDH6 (Clone ID: 051716-J05), CD276 (Clone ID: 050516-Q06) and Her2/neu (Clone ID: 050516-I03) were incubated with SKOV3 (top) and MC7 (middle and bottom) cells, respectively. Induction of GFP expression is evident upon coculture of SIR-expressing Jurkat-NFAT-GFP cells with their respective target cells. The Jurkat-NFAT-GFP cells were engineered to express different SIRs targeting other antigens and the experiment repeated upon coculture with the target cells expressing their respective target antigen. The Jurkat-NFAT-GFP (parental) cells were used as control. The results with different SIRs are summarized in the following summary Table 10A. The names of different SIRs, their SEQ ID NOs, component antigen binding domains and TCR chains can be determined by reference to Tables 7A-7H. A SIR is considered positive in the assay in case the SIR expressing Jurkat-NFAT-GFP cells show greater % GFP positive cells when cultured with the target cell line as compared to parental Jurkat-NFAT-GFP cells. Thus, the Jurkat-NFAT-GFP cells expressing the SIR represented by SEQ ID NO: 1207 showed greater induction of GFP expression when cocultured with LAN5 cell as compared to parental Jurkat-NFAT-GFP cells but did not show greater GFP induction when cocultured with Karpass 299, SUDHL-1 or H460 cell lines. The signs +/−, +, 2+ etc. after the name of the cell lines indicate the relative degree of positivity on the Jurkat-NFAT-GFP assay as measured by the % GFP positive cells after culture of the SIR expressing Jurkat-NFAT-GFP cells with that cell line. The results demonstrate that there is a different SIRs containing the binding domain derived from the same antibody (e.g. FMC63) show great diversity in their ability to activate NFAT signaling using this assay when exposed to the identical cell line depending upon the TCR chain and the linker used in their construction. In addition, great diversity of response against the same target cell line is observed with Jurkat cells expressing SIRs containing different antigen binding domains targeting the same antigen (e.g., SIRs having antigen binding domains derived form different CD19 antibodies) even when the SIRs share the same TCR chains and linkers. Finally, Jurkat cells expressing SIRs targeting different antigens (e.g. CD19 vs CD20) show a diversitiy of response when exposed to the same target cell line. Thus, a diverse immune response can be generated against a single target cell by combining SIRs with different TCR chains, linkers, antigen binding domains and target specificity. Table 10A also summarizes the results of GLuc based T cell cytotoxicity assay observed with different SIRs when exposed to their target cell lines. The signs +/−, + and 2+ etc indicate the degree of cytoxicity observed using the Gluc cytotoxicity assay following 4-96 hour co-culture of the target cell line with SIR-expressing T cells as compared to control T cells, i.e., T cells expressing no SIR or an irrelevant SIR (e.g., a SIR targeting an antigen not expressed on the particular target cell line), when the assay is performed under similar conditions. Again, similar to the results obtained with Jurkat-NFAT-GFP cells, T cells expressing different SIRs show great diversity in their ability to exert cytotoxicity when exposed to their target antigen expressing cells depending upon their TCR chains, linkers, antigen binding domains, target specificity and the target cell line. A similar diversity in the ability to induce cytokine production (e.g. IL2, TNFα and IFNγ) was observed among T cells expressing different SIRs depending upon their TCR chains, linkers, antigen binding domains, target specificity and the target cell line when they were exposed to the target cell line under comparable conditions. However cytokine production by SIR-T cells when exposed to their target cells was generally lower than that observed with comparable CAR-T cells when the assay was performed under similar conditions. The T cells expressing the different SIRs containing the same antigen binding domain but different TCR chains and linkers also showed difference in proliferation and expression of exhaustion markers when assayed under similar conditions.

Table 10A also summarize results with SIRs that contain a fusion of the extracellular domains of TCRα and TCRβ chains with the extracellular, transmembrane and cytosolic domains of CD3z chains with and without an optional costimulatory domain derived from 41BB or CD28. An exemplary SIR of this type based on FMC63 binding domain is CD8SP-FMC63-vL-TCRb-KAC-ECD-Bam-CD3zECDTMCP-opt-F-P2A-SP-FMC63-vH-hTCRa-CSDVP-ECDn-CD3zECDTMCP-opt2-F-F2A-PAC (SEQ ID NO: 10554). In this construct the vL fragment of FMC63 is attached to TCRb-KAC-ECD-Bam-CD3zECDTMCP-opt chain (SEQ ID NO:12402) while the vH fragment of FMC63 is attached to hTCRa-CSDVP-ECDn-CD3zECDTMCP-opt2 chain (SEQ ID NO: 12422). This SIR was strongly positive in Jurkat-NFAT-GFP assay but showed low antigen binding activity as measured by binding to soluble CD19-NLuc fusion protein. Several other constructs of similar design but with different variant of TCRa and TCRb chains are represented by SEQ ID NO: 10552 to 10557 and showed strong but varying level of activity in the Jurkat-NFAT-GFP assay and T cell cytotoxicity assay. In the SIR construct CD8SP-FMC63-vL-hTCRaECDn-CD3zECDTMCP-opt2-F-F2A-SP-FMC63-vH-TCRbECD-Bam-CD3zECDTMCP-opt-F-P2A-PAC (SEQ ID NO: 10564), the FMC63 vL fragment is attached to TCRaECDn-CD3zECDTMCP-opt2 chain (SEQ ID NO: 12421) while the FMC63 vH fragment is attached to TCRbECD-Bam-CD3zECDTMCP-opt (SEQ ID NO: 12401). This construct also showed strong positivity in the Jurkat-NFAT-GFP assay. The construct CD8SP-FMC63-vL-TCRbECD-Bam-CD3zECDTMCP-BBz-opt-F-P2A-SP-FMC63-vH-Myc4-hTCRaECDn-CD3zECDTMCP-BBz-opt2-F-F2A-PAC (SEQ ID NO:10565) that contains a costimulatory domain from 41BB inserted in the CD3z cytoplasmic domain of each of the two chains was also active in the Jurkat-NFAT-GFP assay. The construct, (SEQ ID NO: 10563) is similar to SEQ ID NO: 10565 in design but only one of its chains contains a 41BB costimulatory domain. This construct was also active in the Jurkat-NFAT-GFP assay. Finally, the construct CD8SP-FMC63-vL-V5-TCRbECD-Bam-CD3zECDTMCP-opt-F-P2A-SP-FMC63-vH-Myc-hTCRaECDn-CD3zECDTM-28z-opt2-F-F2A-PAC (SEQ ID NO: 10557), which contains a CD28 costimulatory domain on one of the chains, was also active in the Jurkat-NFAT-GFP assay.

TABLE 10A

Summary of NFAT-GFP and T-Cell Cytotoxicity Assays With A Diverse Pool of SIRS Targeting Different Antigens

| Positive Target | CLONE ID# | SEQ ID DNA | NFAT-GFP ASSAY Positive Cell lines | T-CELL Cytotoxicity Assay Positive cell line |
|---|---|---|---|---|
| Amyloid | 102116-A05 | 1208 | RAJI (+/−), U266 (+/−) | |
| AFP | 012617-N02 | 11456 | HepG2 (+/−) | HepG2 (+) |
| AFP | 020217-B05 | 1394 | HepG2 (+/−) | HepG2 (3+) |
| AFP | 020717-R04 | 1396 | HepG2 (2+) | |
| AFP | 012617-M05 | 11455 | HepG2 (2+) | |
| AFP | 021317-E02 | 11457 | HepG2 (+) | |
| Alk | 051816-Z01 | 1207 | LAN5 (2+) | |
| Alk | 042916-D02 | 1627 | LAN5 (2+) | LAN5 (3+) |
| Alk | 042916-C05 | 1626 | LAN5 (+/−) | |
| Alk | 102616-D06 | 1206 | LAN5 (+) | |
| B7H4 | 121516-O07 | 1387 | MCF7 (3+) | |
| B7H4 | 121516-N07 | 1388 | MCF7 (3+) | |
| BCMA | 011116-A07 | 1212 | L363 (2+), U266 (4+) | |
| BCMA | 041416-U01 | 1422 | L363 (2+), U266 (2+) | |

TABLE 10A-continued

Summary of NFAT-GFP and T-Cell Cytotoxicity Assays With A Diverse Pool of SIRS Targeting Different Antigens

| Positive Target | CLONE ID# | SEQ ID DNA | NFAT-GFP ASSAY Positive Cell lines | T-CELL Cytotoxicity Assay Positive cell line |
|---|---|---|---|---|
| BCMA | 032216-C04 | 1212 | L363 (3+), U266 (3+), RAJI (2+) | L363 (2+), U266 (2+) |
| BCMA | 102116-D01 | 1634 | L363 (2+), U266 (2+) | |
| BCMA | 101416-A05 | 1213 | U266 (+) | |
| BCMA | 030817-A05 | 1398 | L363 (2+), U266 (3+) | |
| BCMA | 030817-C02 | 1397 | L363 (+/−), U266 (+) | |
| BCMA | 030817-B04 | 1399 | L363 (4+), U266 (4+) | |
| BCMA | 031517-S02 | 11459 | L363 (+/−), U266 (+/−) | |
| BCMA | 031517-T06 | 11460 | L363 (+/−), U266 (+/−) | |
| BCMA | 072717-G01 | 10579 | L363 (+/−), U266 (+/−) | U266 (+/−) |
| CCR4 | 091616-Z01 | 1215 | L428 (+/−) | |
| IgFc | 020416-B06 | 2069 | RAJI + Rituximab(3+) | RAJI + Rituximab (2+) |
| IgFc | 041916-T04 | 1854 | L428 (+/−) | |
| IgFc | 091616-A01 | 1219 | RAJI + Rituximab (+/−) | |
| CD23 | 121416-E04 | 1814 | L1236 (+/−) | |
| CD23 | 121416-I04 | 2029 | L1236 (+/−) | |
| CD19 | 050515-L05 | 900 | RAJI(2+), NALM6(2+) | RAJI (2+) |
| CD19 | 091015-Y08 | 926 | RAJI(2+), NALM6(3+) | RAJI (4+) |
| CD19 | 082815-Q08 | 942 | RAJI(2+), NALM6(2+) | |
| CD19 | 010616-S06 | 910 | RAJI (+/−) | |
| CD19 | 010716-B04 | 4531 | RAJI (4+) | |
| CD19 | 081415-D06 | 992 | RAJI(5+), NALM6(3+) | RAJI (3+) |
| CD19 | 082815-G07 | 1620 | RAJI(2+), NALM6(2+) | RAJI (+) |
| CD19 | 080815-F02 | 922 | RAJI (2+) | RAJI (+/−) |
| CD19 | 020116-W03 | 945 | RAJI(+/−), NALM6(+) | |
| CD19 | 012216-S02 | 909 | RAJI (+/−) | |
| CD19 | 051216-K04 | 918 | RAJI (+) | RAJI (2+) |
| CD19 | 051216-E05 | 911 | RAJI (+) | |
| CD19 | 051216-G01 | 912 | RAJI (+/−) | |
| CD19 | 051716 I08 | 919 | RAJI (4+) | |
| CD19 | 052316-F01 | 936 | RAJI (+) | |
| CD19 | 050216-S08 | 913 | RAJI (+/−) | |
| CD19 | 050216-S08 & 041916-A02 | 913 & 997 | RAJI (2+) | |
| CD19 | 050216-S08 & 041916-B03 | 913 & 997 | RAJI (3+) | |
| CD19 | 050216-T02 | 913 | RAJI (+/−) | |
| CD19 | 052616-X07 | 916 | RAJI (+/−) | |
| CD19 | 053116-G03 | 938 | RAJI (+/−) | |
| CD19 | 060816-J02 | 914 | RAJI (+) | |
| CD19 | 053116-E04 | 955 | RAJI (+/−) | |
| CD19 | 031516-K07 | 996 | RAJI (+/−) | |
| CD19 | 060816-K08 | 937 | RAJI (+/−) | |
| CD19 | 031516-J07 | 939 | RAJI (+) | MV411 (+/−) |
| CD19 | 041416-L02 | 1410 | RAJI (+) | |
| CD19 | 041916-A02 | 997 | RAJI (+/−) | |
| CD19 | 041916-B03 | 997 | RAJI (+/−) | |
| CD19 | 121515-Z08 | 1835 | RAJI (+) | |
| CD19 | 021816-O05 | 991 | RAJI(+/−), NALM6(+) | |
| CD19 | 062416-Z07 | 915 | RAJI (2+) | |
| CD19 | 061616-A01 | 917 | RAJI (+/−) | |
| CD19 | 063016-B03 | 931 | RAJI (2+) | |
| CD19 | 010616-C01 | 1200 | RAJI(3+), NALM6(3+) | |
| CD19 | 032216-Q05 | 1410 | RAJI (+/−) | |
| CD19 | 032416-M07 | 4741 | L428 (+/−) | |
| CD19 | 032216-N01 | 992 | RAJI (+/−) | |
| CD19 | 102416-W03 | 10487 | RAJI(+), NALM6(+) | RAJI (2+), NALM6 (2+) |
| CD19 | 102416-Q06 | | RAJI(+), NALM6(+) | RAJI (4+), NALM6 (2+) |
| CD19 | 102416-R03 | | NALM6 (+/−) | RAJI (+) |
| CD19 | 102416-S04 | | NALM6 (+/−) | |
| CD19 | 102416-P06 | | NALM6 (+/−) | NALM6 (2+) |

TABLE 10A-continued

Summary of NFAT-GFP and T-Cell Cytotoxicity Assays With
A Diverse Pool of SIRS Targeting Different Antigens

| Positive Target | CLONE ID# | SEQ ID DNA | NFAT-GFP ASSAY Positive Cell lines | T-CELL Cytotoxicity Assay Positive cell line |
|---|---|---|---|---|
| CD19 | 120616-C01 | | RAJI(+), NALM6 (2+) | |
| CD19 | 120616-D01 | | RAJI(+), NALM6 (2+) | |
| CD19 | 101415-M05 | 901 | RAJI(2+), NALM6(2+) | RAJI (2+) |
| CD19 | 100515-E03 | 902 | RAJI(4+), NALM6(3+) | RAJI (+), NALM6 (3+) |
| CD19 | 110916-M04 | 10479 | RAJI(4+), NALM6(3+) | RAJI (4+), NALM6 93+) |
| CD19 | 120916-R01 | 10487 | RAJI(+), NALM6 (+) | |
| CD19 | 120716-Q04 | | RAJI(2+), NALM6 (+) | RAJI (2+), NALM6 (2+) |
| CD19 | 110916-P02 | 10481 | NALM6(+/−) | NALM6 (+) |
| CD19 | 110916-N08 | 10480 | RAJI(2+), NALM6(3+) | |
| CD19 | 072516-B05 | 1201 | RAJI(+/−) | RAJI, NALM6 (+/−) |
| CD19 | 101216-H03 | 10474 | RAJI(2+), NALM6(2+) | RAJI (4+), NALM6 (2+) |
| CD19 | 123016-S04 | | RAJI (+/−) | |
| CD19 | 091216-K03 | | RAJI (+/−) | |
| CD19 | 010417-H01 | 10508 | RAJI(2+), NALM6 (2+) | NALM6 (+) |
| CD19 | 123016-R02 | | RAJI (+/−) | |
| CD19 | 012317-N03 | | RAJI (+), NALM6 (+/−) | |
| CD19 | 112116-R08 | 10482 | RAJI(3+), NALM6 (+) | |
| CD19 | 112116-T08 | 10484 | RAJI(+), NALM6(+/−) | |
| CD19 | 121516-U07 | 10488 | RAJI(+), NALM6 (+) | |
| CD19 | 121516-J07 | 10491 | RAJI(+), NALM6 (2+) | |
| CD19 | 121516-V07 | 10489 | RAJI(+/−), NALM6 (+/−) | |
| CD19 | 121516-W05 | 10490 | RAJI (+/−), NALM6 (+/−) | |
| CD19 | 012417-H04 | | RAJI (2+), NALM6 (+) | |
| CD19 | 010717-B06 | 10572 | RAJI (3+), NALM6 (3+) | RAJI (+), NALM6 (2+) |
| CD19 | 010717-A06 | 10571 | RAJI, NALM6 | |
| CD19 | 020617-E01 | 10511 | RAJI (2+), NALM6 (+) | |
| CD19 | 020617-F01 | 10512 | RAJI (5+), NALM6 (4 +) | |
| CD19 | 040617-A09 | 10476 | RAJI (5+), NALM6 (3+) | RAJI (+) |
| CD19 | 040617-B09 | 10477 | RAJI (4+), NALM6 (3+) | |
| CD19 | 040617-C09 | 10478 | RAJI (5+), NALM6 (4+) | RAJI (+) |
| CD19 | 041117-M04 | 10552 | RAJI (4+), NALM6 (2+) | |
| CD19 | 041117-N06 | 10553 | RAJI (4+), NALM6 (2+) | |
| CD19 | 042117-A05 | 10554 | RAJI (5+), NALM6 (4+) | |
| CD19 | 042117-B01 | 10555 | RAJI (4+), NALM6 (3+) | |
| CD19 | 042117-D01 | 10556 | RAJI (2+), NALM6 (+) | |
| CD19 | 042517-X04 | 10557 | RAJI (3+), NALM6 (2+) | |
| CD19 | 051017-M04 | | NALM6 (+/−), Bv173 (+/−) | NALM6 (+) |
| CD19 | 051217-S02 | 10564 | RAJI (3+), NALM6 (+) | |
| CD19 | 053117-A01 | 10565 | RAJI (3+), NALM6 (+) | |
| CD19 | 053117-B01 | | RAJI (+), NALM6 (+/−) | |
| CD19 | 053117-F01 | 10566 | RAJI (2+), NALM6 (+) | |
| CD19 | 053117-G01 | 10567 | RAJI (+), NALM6 (+/−) | |
| CD19 | 062017-I03 | 10570 | RAJI (+), NALM6 (+/−) | |
| CD19 | 050517-D07 | 10562 | RAJI (2+), NALM6 (+) | |

TABLE 10A-continued

Summary of NFAT-GFP and T-Cell Cytotoxicity Assays With
A Diverse Pool of SIRS Targeting Different Antigens

| Positive Target | CLONE ID# | SEQ ID DNA | NFAT-GFP ASSAY Positive Cell lines | T-CELL Cytotoxicity Assay Positive cell line |
|---|---|---|---|---|
| CD19 | 050517-E07 | 10563 | RAJI (3+), NALM6 (2+) | |
| CD19 | 010616-A01 | 1196 | RAJI (2+) | |
| CD19 | 010616-B01 | 1197 | RAJI (3+) | |
| CD19 | 071715-C06 | 1110 | RAJI (+/−) | |
| CD19 | 082815-F06 | 1623 | RAJI (+), NALM6 (+) | RAJI (2+) |
| CD19 | 060816-I02 | 1111 | RAJI (+/−) | |
| CD19 | 121515-Y06 | 1838 | RAJI (+/−) | |
| CD19 | 041316-H02 | 1168 | RAJI (+/−) | |
| CD19 | 070215-M03 | 1021 | RAJI (3+), NALM6 (2+) | RAJI (3+) |
| CD19 | 121515-X07 | 1018 | RAJI (+) | RAJI (+) |
| CD19 | 051216-D08 | 1022 | RAJI (+) | |
| CD19 | 051216-F03 | 1023 | RAJI (+) | |
| CD19 | 052316-D03 | 1017 | RAJI (+) | |
| CD19 | 052316-J03 | 1024 | RAJI (+) | |
| CD19 | 060816-H05 | 1025 | RAJI (+) | |
| CD19 | 082815-E05 | 1622 | RAJI (4+) | RAJI (+) |
| CD19 | 092515-Y08 | 1098 | RAJI (+), NALM6 (+) | |
| CD19 | 020216-B07 | 1026 | RAJI (+) | RAJI (2+) |
| CD19 | 041816-F02 | 1037 | RAJI (+) | |
| CD19 | 040716-B04 | 1028 | RAJI (+/−) | |
| CD19 & CD20 | 010417-G08 | 10507 | RAJI (+), NALM6 (+) | RAJI (+), NALM6 (2+) |
| CD19 & CD20 | 030217-D02 | 10520 | RAJI (2+), NALM6 (+) | |
| CD19 & CD30 | 041216 C02 | 1029 | L428 (+/−) | |
| CD19 & CD33 | 010417-B04 | 10503 | RAJI (+), NALM6 (+), HL60 (+/−) | RAJI (+), NALM6 (2+), HL60 (4+) |
| CD19 & CD33 | 030217-E05 | 10516 | RAJI (+) | |
| CD19 & CD33 | 030217-H02 | 10522 | RAJI (2+), NALM6 (+) | HL60 (3+) |
| CD19 & CD38 | 030217-G04 | 10521 | RAJI (+), NALM6 (+) | |
| CD19 & CD79 | 040716-I04 | 1030 | RAJI (+/−), U266 (+/−), L363 (+/−) | |
| CD19 & CD123 | 041216 G04 | 1032 | RAJI (+/−) | |
| CD19 & CD123 | 030217-I05 | 10523 | RAJI (+/−), NALM6 (+/−), L428 (+/−) | |
| CD19 & Lym1 | 030217-J05 | 10517 | RAJI (2+), NALM6 (+/−) | |
| CD19 & Lym2 | 030217-K05 | 10518 | RAJI (3+), NALM6 (+) | |
| CD19 & CLL1 | 040716-F05 | 1035 | RAJI (+/−) | |
| CD19 & CLL1 | 040716-G02 | 1036 | RAJI (+/−) | |
| CD19 & Mpl | 063016-E01 | 1138 | RAJI (2+), HEL (+/−) | |
| CD19 & Mpl | 010417-E08 | 10505 | RAJI (+), NALM6 (+), HEL (+) | |
| CD19 & BCMA | 010417-F05 | 10506 | RAJI (2+), NALM6 (2+) | RAJI (+/−), NALM6 (+), L363 (2+), U266 (2+) |
| CD19 & CS1 | 010417-C03 | 10504 | RAJI (+), NALM6 (+/−) | |
| CD19 & CS1 | 030217-A05 | 10519 | RAJI (+), NALM6 (+/−), L363 (+/−), U266 (+/−) | |
| CD19 | 010417-H05 | 11472 | RAJI (2+), NALM6 (+) | RAJI (2+), NALM6 (2+) |
| CD19 | 010417-L03 | 11708 | RAJI (+), NALM6 (+) | RAJI (+/−), NALM6 (+/−) |
| CD19 | 010417-F05 | 10506 | RAJI (+), NALM6 (+) | RAJI (2+), NALM6 (2+) |
| CD19 | 010417-G06 | | RAJI (+) | NALM6 (+) |
| CD19 | 011317-A06 | 11708 | RAJI (2+), NALM6 (2+) | |
| CD19 | 010417-I04 | 11589 | RAJI (+), NALM6 (+/−) | |
| CD19 | 011317-B06 | 11710 | RAJI (3+), NALM6 (2+) | |
| CD19 | 012417-H04 | 11474 | RAJI (2+), NALM6 (+) | NALM6 (+) |

TABLE 10A-continued

Summary of NFAT-GFP and T-Cell Cytotoxicity Assays With
A Diverse Pool of SIRS Targeting Different Antigens

| Positive Target | CLONE ID# | SEQ ID DNA | NFAT-GFP ASSAY Positive Cell lines | T-CELL Cytotoxicity Assay Positive cell line |
|---|---|---|---|---|
| CD19 | 022817-L08 | 11240 | RAJI (3+), NALM6 (2+) | RAJI (3+), NALM6 (3+) |
| CD19 | 012417-I04 | 11475 | RAJI (+/−) | NALM6 (+/−), L363 (+/−), U266 (+/−) |
| CD19 | 012617-O05 | 11477 | RAJI (+/−) | NALM6 (+), L363 (+), U266 (+) |
| CD19 | 020717-P08 | 10514 | RAJI (+) | |
| CD19 | 020817-U02 | 11476 | RAJI (+), NALM6 (+/−) | |
| CD19 | 030817-B07 | 10815 | RAJI (5+), NALM6 (4+) | |
| CD19 | 030817-V07 | 11245 | RAJI (6+), NALM6 (5+) | |
| CD19 | 070517-G02 | 10573 | RAJI (+), NALM6 (+/−) | RAJI (+), NALM6 (+/−) |
| CD19 | 070517-H02 | 11479 | RAJI (2+), NALM6 (+) | RAJI (+), NALM6 (+/−) |
| CD19 | 022817-K08 | 11244 | RAJI (+), NALM6 (+/−) | |
| CD19 | 022817-J01 | 11478 | RAJI (+), NALM6 (+/−) | |
| CD19 | 081017-H01 | 11526 | RAJI (+/−), NALM6 (+/−) | RAJI (+), NALM6 (+/−) |
| CD19 | 071417-G01 | 10524 | RAJI (+), NALM6 (+/−) | |
| CD19 | 071417-O08 | 10529 | RAJI (2+), NALM6 (+) | |
| CD19 & CD20 | 071417-H01 | 10525 | RAJI (+), NALM6 (+/−) | |
| CD19 & CD22 | 071417-I05 | 10526 | RAJI (2+), NALM6 (+) | |
| CD19 & CD22 | 071417-Q05 | 10530 | RAJI (+), NALM6 (+) | |
| CD19 & CD22 | 080217-L08 | 10538 | RAJI (2+), NALM6 (+), Bv173 (+) | NALM6 (+) |
| CD19 | 110217-A03 | 10492 | RAJI (+/−), NALM6 (+/−) | |
| CD19 | 110217-B04 | 10493 | RAJI (+/−), NALM6 (+/−) | |
| CD19 | 110217-C03 | 10494 | RAJI (+/−), NALM6 (+/−) | |
| CD19 | 110217-D01 | 10495 | RAJI (+/−), NALM6 (+/−) | |
| CD19 | 020617-F01 | | RAJI (4+), NALM6 (3+) | |
| CD19 | 092517-F01 | 11544 | RAJI (+), NALM6 (+) | |
| CD19 | 101817-A01 | 10880 | RAJI (4+), NALM6 (3+) | |
| CD20 | 100615-D05 | 1221 | RAJI (3+), NALM6 (3+) | RAJI (5+) |
| CD20 | 051716-E02 | 1113 | RAJI (+/−) | RAJI (2+) |
| CD20 | 041216-A04 | 1431 | RAJI (2+), NALM6 (+/−) | |
| CD20 | 090116-B02 | 1642 | RAJI (2+) | RAJI (2+) |
| CD20 | 083116-B04 | 1856 | RAJI (2+) | RAJI (2+) |
| CD20 | 102016-D04 | 1857 | NALM6 (+/−) | NALM6 (3+) |
| CD20 | 110116-B05 | 2072 | NALM6 (+/−) | RAJI (+/−), NALM6 (+) |
| CD20 | 012417-J04 | 11486 | RAJI (+) | NALM6 (2+) |
| CD20 | 012417-K04 | 11487 | RAJI (+) | RAJI (+), NALM6 (+/−) |
| CD20 | 012517-Q12 | 11490 | RAJI (+) | RAJI (3+), NALM6 (2+) |
| CD20 | 022817-T04 | 11255 | RAJI (3+), NALM6 (2+) | |
| CD20 | 030817-F07 | 10826 | RAJI (+/−) | |
| CD20 | 030817-W07 | 11252 | RAJI (+/−) | |
| CD20 | 030817-X05 | 11250 | RAJI (+/−) | |
| CD20 | 030817-E07 | 10824 | U266 (+/−) | |
| CD20 | 031417-L06 | 11253 | RAJI (+/−) | |
| CD20 | 031417-N06 | 10823 | RAJI (4+), NALM6 (+) | |

TABLE 10A-continued

Summary of NFAT-GFP and T-Cell Cytotoxicity Assays With
A Diverse Pool of SIRS Targeting Different Antigens

| Positive Target | CLONE ID# | SEQ ID DNA | NFAT-GFP ASSAY Positive Cell lines | T-CELL Cytotoxicity Assay Positive cell line |
|---|---|---|---|---|
| CD20 | 031417-O06 | | RAJI (4+), NALM6 (+/−) | |
| CD20 | 030917-Z01 | 11256 | RAJI (2+), NALM6 (+/−) | |
| CD20 | 031517-W03 | 11488 | RAJI (+/−) | |
| CD20 | 041417-B06 | 10855 | RAJI (+/−) | |
| CD20 | 012617-S04 | 11484 | RAJI (3+), NALM6 (+/−) | RAJI (+), NALM6 (4+) |
| CD22 & CD22 | 080217-N07 | 10533 | RAJI (3+), NALM6 (2+), Bv173 (+) | |
| CD22 & CD20 & CD19 | 071417-S05 | 10531 | RAJI (+), NALM6 (+) | |
| CD22 | 102715-E07 | 1225 | RAJI (+) | |
| CD22 | 050516-V06 | 1224 | RAJI (+/−) | |
| CD22 | 041216-C05 | 1433 | RAJI (+/−), NALM6 (+/−) | NALM6 (+) |
| CD22 | 091216-A03 | 1643 | RAJI (+) | |
| CD22 | 081516-I03 | 1859 | RAJI (+/−) | |
| CD22 | 012517-E12 | 11545 | RAJI (+), NALM6 (+/−) | RAJI (2+), NALM6 (2+) |
| CD22 | 031417-A06 | 11311 | RAJI (6+), NALM6 (5+) | |
| CD22 | 040417-R02 | 11284 | RAJI (3+), NALM6 (+) | |
| CD22 | 040417-W08 | 10856 | RAJI (2+) | |
| CD22 | 040417-V03 | 10854 | RAJI (+/−) | |
| CD22 | 041117-S01 | 11285 | RAJI (+/−) | |
| CD22 | 041917-L04 | 11520 | RAJI (+/−) | |
| CD22 | 042517-B02 | 11288 | RAJI (+), NALM6 (+/−) | |
| CD22 | 042517-A03 | 10858 | RAJI (+) | |
| CD22 | 062717-O02 | 11519 | RAJI (+/−) | |
| CD22 | 062717-P06 | 11521 | RAJI (+/−) | |
| CD22 | 062717-Q04 | 11522 | RAJI (+) | |
| CD22 & CD19 | 071417-T06 | 10532 | RAJI (2+), NALM6 (+) | |
| CD30 | 010716-K01 or 063016-K02 ? | 1227 | Jurkat (+), L428 (+), L540 (+), L1236 (+) | L363 (+), U266 (+), Jurkat (+/−) |
| CD30 | 083116-D03 | 1861 | L428 (+/−) | |
| CD33 | 052416-K05 | 1229 | HL60 (2+), MOLM13 (+/−) | MOLM13 (5+) |
| CD33 | 041216-G06 | 1440 | RAJI (+/−), HL60 (+), THP1 (+/−), KG1 (+/−) | |
| CD33 | 032216-W04 | 1230 | HL60 (+), MOLM13 (3+) | |
| CD33 | 090116-F02 | 1649 | HL60 (+/−) | HL60 (+) |
| CD33 | 083116-E02 | 1864 | HL60 (+/−) | HL60 (3+) |
| CD33 | 012517-I12 | 11491 | HL60 (+/−) | HL60 (3+) |
| CD33 | 022217-X03 | 11493 | U266 (+/−) | |
| CD33 | 060717-T02 | 10829 | HL60 (2+) | |
| CD38 & BCMA | 062717-U01 | | U266 (+/−) | |
| CD70 | 051116-C05 | 4774 | THP1 (+/−) | |
| CD79b | 041216-H05 | 1130 | RAJI (+) | RAJI (4+), L363 (4+) |
| CD79b | 090116-G02 | 1654 | RAJI (+) | |
| CD79b | 110116-G04 | 2084 | RAJI (+/−) | RAJI (+/−) |
| CD123 | 111215-J02 | 4588 | MOLM13 (+), Bv173 (+) | |
| CD123 | 111215-K06 | 1257 | Bv173 (+), THP1 (+), | |
| CD123 | 100615-A02 | 1235 | MOLM13 (+), Bv173 (+), THP1 (+), KG1 (2+) | |
| CD123 & IgFc | 012116-C05 | 4589 | RAJI (2+), MOLM13 (2+), Bv173 (+) | |
| CD123 | 041416-K04 | 1445 | RAJI (+/−), L428 (+), BV173 (+/−) | L428 (2+) |
| CD123 | 041416-V03 | 1467 | L428 (+) | Bv173 (5+) |
| CD123 | 090116--I01 | 1655 | L428 (+/−) | |

TABLE 10A-continued

Summary of NFAT-GFP and T-Cell Cytotoxicity Assays With
A Diverse Pool of SIRS Targeting Different Antigens

| Positive Target | CLONE ID# | SEQ ID DNA | NFAT-GFP ASSAY Positive Cell lines | T-CELL Cytotoxicity Assay Positive cell line |
|---|---|---|---|---|
| CD123 | 121516-I05 | 1382 | L428 (7+) | |
| CD123 | 011317-H01 | 11697 | L428 (4+) | |
| CD123 | 012517-F12 | 11465 | L428 (3+) | |
| CD123 | 012517-G12 | 11462 | L428 (+/−) | |
| CD123 | 012517-H12 | 11467 | L428 (3+) | |
| CD123 | 012517-J12 | 11468 | L428 (2+) | |
| CD123 | 012517-K12 | 11469 | L428 (3+) | |
| CD123 | 012517-L12 | 11470 | L428 (4+) | |
| CD123 | 012517-M12 | 11471 | L428 (+) | |
| CD123 | 012517-C12 | 11461 | L428 (3+) | |
| CD123 | 051617-A03 | 10797 | L428 (6+) | L428 (+/−) |
| CD123 | 051617-C07 | 10801 | L428 (4+) | L428 (+) |
| CD123 and IgFc | 041916-R03 | 1133 | L428 (+/−), RAJI (+) | |
| CD138 | 041416-I03 | 1446 | RAJI (+/−), U266 (+/−) | L363 (5+), RAJI (+) |
| CD138 | 100815-A05 | 1236 | L363 (5+), U266 (5+) | L363 (4+), U266 (4+) |
| CD138 | 083116-F05 | 1871 | U266 (+/−) | L363 (+/−) |
| CD138 | 090116-H02 | 1656 | L363 (+), U266 (+) | L363 (+), U266 (+) |
| CD138 | 030316-G03 | 1169 | L363 (+/−), U266 (+/−) | L363 (+), U266 (+) |
| CD138 | 110116-H02 | 2086 | L363 (+/−), U266 (+) | L363 (+/−), U266 (+) |
| CD179b | 063016-Y06 | 1237 | RAJI (+/−), U266 (+/−) | MOLM13 (+) |
| CD200R | 111116-B07 | 1393 | HEL (2+) | HEL (4+) |
| CD276 | 050516-Q06 | 1238 | MCF7 (2+) | |
| CD276 | 042816-C03 | 1658 | U87-MG (+/−) | |
| CDH6 | 062816-U01 | 1242 | SKOV3 (5+) | |
| CDH6 | 063016-T05 | 1241 | SKOV3 (3+), MCF7 (+) | |
| CDH17 | 062816-X02 | 1243 | LoVo (+) | |
| CDH19 | 092916-A05 | 1383 | SKMEL31 (3+), SKMEL37 (2+) | MEL624 (+) |
| CDH19 | 101216-B04 | 1244 | MEL624 (+), SKMEL31 (+), SKMEL37 (+) | |
| CGHb | 090116-H03 | 1248 | PC3 (+/−) | |
| CGHb | 091616-U01 | 1668 | HCT116 (+/−), H460 (+/−) | |
| CLD18A2 (CLDN18A.2) | 082317-G04 | 11529 | L428 (+/−) | |
| CLEC5A | 042816-E05 | 1666 | Kasumi (+/−) | HL60 (4+) |
| CLL1 | 041816-A03 | 5000 | RAJI (+/−), U266 (+/−), L363 (+/−), | |
| CLL1 | 041816-C01 | 1460 | RAJI (+/−), U266 (+/−), L363 (+/−) | |
| CLL1 | 092216-G01 | 1669 | HL60 (+/−) | L363 (+), U266 (+) |
| CS1 | 060616-K04 | 1141 | L363 (2+) | L363 (5+), U266 (4+) |
| CS1 | 041416-P02 | 1464 | U266 (+/−), L363 (+/−) | |
| CS1 | 090116-L01 | 1674 | U266 (+/−), L363 (+) | |
| CS1 | 092916-E07 | 1253 | U266 (3+), L363 (3+) | L363 (+/−), U266 (+/−) |
| CS1 | 091216-L03 | 1673 | U266 (+), L363 (+) | L363 (+/−), U266 (+/−) |
| CS1 | 110116-L01 | 2104 | U266 (+), L363 (+) | L363 (+), U266 (5+) |
| CS1 | 012517-A12 | 11503 | U266 (+/−), L363 (+) | L363 (2+), U266 (2+) |
| CS1 | 011217-E04 | | RAJI (+), NALM6 (+/−), L363 (+/−), U266 (+) | L363 (+), U266 (+) |
| CS1 | 012517-P12 | 11508 | U266 (+/−), L363 (+/−) | L363 (3+), U266 (3+) |
| CS1 | 012517-B12 | 11504 | U266 (2+), L363 (+) | L363 (+), U266 (2+) |
| CS1 | 012517-N12 | 11506 | U266 (2+), L363 (+) | L363 (+/−), U266 (+/−) |

TABLE 10A-continued

Summary of NFAT-GFP and T-Cell Cytotoxicity Assays With
A Diverse Pool of SIRS Targeting Different Antigens

| Positive Target | CLONE ID# | SEQ ID DNA | NFAT-GFP ASSAY Positive Cell lines | T-CELL Cytotoxicity Assay Positive cell line |
|---|---|---|---|---|
| CS1 | 012517-O12 | 11507 | U266 (+), L363 (+/−) | L363 (+/−), U266 (+/−) |
| CS1 | 012517-D12 | 11505 | U266 (+), L363 (+) | L363 (+), U266 (2+) |
| CS1 | 020217-Y07 | 11272 | U266 (3+), L363 (3+) | L363 (+/−), U266 (+/−) |
| CS1 | 022817-N08 | 11270 | U266 (+/−), L363 (+/−) | |
| CS1 | 092916-E07 | 1253 | RAJI (3+), NALM6 (+/−) | |
| CS1 | 022817-O05 | 11271 | U266 (4+), L363 (5+) | |
| CS1 | 042117-C01 | 11273 | U266 (4+), L363 (4+) | |
| CS1-CD19 | 010417-X02 | 10500 | RAJI, NALM6, L363, U266 | |
| CS1-CD19 | 010417-Z03 | 10502 | RAJI, NALM6, L363, U266 | RAJI (+/−), NALM6 (+), L363 (2+), U266 (2+) |
| CS1-CD19 | 010417-V07 | 10498 | RAJI (+), NALM6 (+), L363 (+), U266 (+) | RAJI (+/−), NALM6 (+/−), L363 (2+), U266 (2+) |
| CSF2RA | 051016-A08 | 1675 | THP1 (+) | |
| CSF2RA | 051816-C01 | 1256 | THP1 (4+) | |
| CSF2RA | 050216-B02 | 1676 | MOLM13 (+), THP1 (+) | MV411 (4+), MOLM13 (5+), THP1 (5+) |
| CXCR4 & CD4 | 111915-U05 | 1142 | MOLM13 (+/−), Bv173 (+/−), THP1 (+/−), KG1 (2+) | |
| CXCR4 & CD123 | 111815-E04 | 1170 | U266 (2+), Bv173 (2+) | |
| DLL3 | 071516-N04 | 1263 | LAN5 (+/−) | |
| EGFR | 012216-Z07 | 1172 | LoVo (+), A431 (2+), SKOV3 (2+), LS174T (+/−) | |
| EGFR and CD123 | 102915-J02 | 1174 | LoVo (+), A431 (2+), SKOV3 (2+) | |
| EGFR & CEA | 102915-B02 | 1175 | LoVo (+), A431 (+/−) | |
| EGFR & CEA | 102915-A02 | 4598 | LoVo (+/−), A431 (+/−) | |
| EGFR & CEA | 102915-D03 | 4599 | HeLa (+) | |
| EGFR and Her2 | 102915-K03 | 1176 | LoVo (+/−), OVCAR3 (+/−), HeLa (+/−) | |
| EGFR and Her2 | 102915-F01 | 1177 | LoVo (+/−), A431 (+/−), SKOV3 (+) | |
| EGFR and Her2 | 102915-L03 | 1178 | LoVo (+), A431 (+), A549 (2+), HeLa (3+), OVCAR3 (+), SKOV3 (+) | |
| EGFR and Mesothelin | 102915-G07 | 1179 | A431 (2+), SKOV3 (2+) | |
| EGFRviii | 100615-C06 | 1269 | LoVo (+/−), HeLa (+/−) | |
| EpCAM1 | 121815-B07 | 1271 | A549 (2+), Hela (3+), PC3 (2+), LNCAP (3+), SKOV3 (+) | LNCAP (+/−), PC3 (+), SKOV3 (+/−) |
| EpCAM1 | 121815-C05 | 1272 | A549 (2+), Hela (3+), PC3 (2+), LNCAP (3+), SKOV3 (+) | PC3 (+/−), SKOV3 (+/−) |
| Folate Receptor 1 | 102915-P07 | 1276 | LoVo (4+), A431 (2+), A549 (+), OVCAR3 (5+), SKOV3 (5+) | LNCAP (4+), PC3 (5+), SKOV3 (5+) |
| Folate Receptor 1 | 111516-M03 | 1693 | SKOV3 (+), LoVo (+/−) | |
| Folate Receptor beta | 121516-H04 | 1384 | RAJI (+/−) | |
| FSHR | 090116-E05 | 1277 | SKOV3, H460 | |

TABLE 10A-continued

Summary of NFAT-GFP and T-Cell Cytotoxicity Assays With
A Diverse Pool of SIRS Targeting Different Antigens

| Positive Target | CLONE ID# | SEQ ID DNA | NFAT-GFP ASSAY Positive Cell lines | T-CELL Cytotoxicity Assay Positive cell line |
|---|---|---|---|---|
| GCC | 121416-C06 | 2245 | CACO2 (+/−) | |
| GCC | 121416-F01 | 1816 | CACO2 (+/−) | |
| GCC | 011817-B07 | 1389 | CACO2 (+/−) | |
| GAD | 021716-H06 | 1137 | RAJI (3+) | |
| GD2 | 011416-E08 | 1279 | SKMEL31 (5+) | |
| GD2 | 111615-W05 | 1278 | SKMEL31 (4+) | |
| GD2 | 041816-E01 | 1489 | SKMEL31 (+) | |
| GFRa | 062816-W05 | 1282 | TT (+/−) | |
| Fucosyl-GM1 | 101216-Y07 | 1283 | H460 (+/−), HCT116 (+/−) | |
| GPRC5D | 100616-C03 | 1285 | U266 (+) | |
| GPRC5D | 021517-I01 | 11511 | L363 (+/−) | |
| GPRC5D | 031517-Q04 | 11512 | L363 (+/−) | |
| GPRC5D | 060717-L04 | 10848 | L363 (2+), U266 (+) | |
| HER2 | 050516-W01 | 1294 | MCF7 (+/−) | |
| HER2 | 042816-I05 | 1714 | MCF7 (+), SKBR3 (+) | |
| Her3 and Her2 | 111815-B05 | 1181 | LoVo (+), OVCAR3 (+) | |
| Her3 | 040716-B03 | 1717 | MCF7 (+/−), SKBR3 (+), A431 (+) | |
| Her3 and Her2 | 040716-H06 | 1182 | MCF7 (+), SKBR3 (+) | |
| HIV1-env gp | 091616-Y01 | 1297 | HL2-3 (+/−) | |
| HIV1-env gp | 091616-X01 | 1300 | TF228.1.1.6 (+), HL2-3 (+/−) | |
| HIV1-env gp | 101216-B05 | 1298 | TF228.1.1.6 (+) | HL2-3 (2+) |
| HIV1-env gp | 121416-H05 | 1625 | HL2-3 (+/−), TF228.1.1.6 (+/−) | HL2-3 (4+), TF228.1.1.6 (+/−) |
| HIV1-env gp | 121416-D03 | 2055 | HL2-3 (+/−), TF228.1.1.6 (+) | |
| HLA-A2 | 060717-M01 | 10849 | U266 (3+), Bv173 (3+) | |
| IL11Ra | 050516-R06 | 1304 | K562 (+) | Bv173 (2+) |
| IL6R | 010416-L04 | 1166 | RAJI (5+), U266 (2+), THP1 (4+) | |
| IL13Ra | 050516-T06 | 1307 | U87MG (+/−) | |
| IL13Ra | 042916-B04 | 1728 | U87MG | |
| LAMP1 | 101216-X03 | 1309 | U266 (+), L363 (+/−) | |
| Igk-Light chain | 071417-W08 | 11523 | U266 (+/−) | U266 (+/−) |
| LHR | 091616-T05 | 1950 | LNCAP (+/−) | |
| L1CAM | 010716-G03 | 1312 | LoVo (+), A549 (+), SKOV3 (3+) | LNCAP (+/−), PC3 (+/−), SKOV3 (+/−) |
| L1CAM | 080316-T02 | 1136 | SKOV3 (+), MCF7 (+) | |
| L1CAM | 091216-H07 | 1734 | SKOV3 (3+) | |
| Lym1 | 021216-H02 | 1314 | RAJI (3+) | RAJI (5+) |
| Lym1 | 041416-M03 | 1165 | RAJI (5+) | |
| Lym1 | 090116-J01 | 1736 | RAJI (3+), NALM6 (+) | RAJI (+) |
| Lym1 | 110116-J04 | 2166 | RAJI (2+), NALM6 (2+) | RAJI (4+), NALM6 (3+) |
| Lym2 | 100615-B07 | 1315 | RAJI (+), U266 (+) | RAJI (4+) |
| Lym2 | 041416-N03 | 1525 | RAJI (+/−) | |
| Lym2 | 032216-Y07 | 1315 | RAJI (+) | |
| Lym2 | 090116-K02 | 1737 | RAJI (2+), NALM6 (2+) | |
| Lym2 | 083016-B06 | 1952 | RAJI (+) | RAJI (3+) |
| CMET-CD19 | 011917-S05 | | RAJI (+), NALM6 (+/−) | |
| CMET-CD19 | 011917-T05 | | RAJI (+), NALM6 (+/−) | |
| CMET-CD20 | 011917-U05 | | RAJI (+/−), U266 (+/−) | |
| MPL-TPO-R | 040315-U02 | 1112 | HEL (3+), RAJI-MPL (2+) | |
| MPL-TPO-R | 040716-A07 | 1746 | HEL (4+) | |
| MPL-TPO-R | 042116-G01 | 4862 | HEL (+/−) | HEL (4+) |
| MPL-TPO-R | 091316-A01 | 1747 | HEL (+/−) | |
| MPL-TPO-R | 092216-B03 | 1744 | HEL (+) | |
| MPL-TPO-R | 101817-B02 | 10878 | HEL (+) | |
| MPL-TPO-R | 101817-C03 | 10879 | HEL (3+) | |

TABLE 10A-continued

Summary of NFAT-GFP and T-Cell Cytotoxicity Assays With
A Diverse Pool of SIRS Targeting Different Antigens

| Positive Target | CLONE ID# | SEQ ID DNA | NFAT-GFP ASSAY Positive Cell lines | T-CELL Cytotoxicity Assay Positive cell line |
|---|---|---|---|---|
| MPL-TPO-R | 080317-G07 | 11302 | HEL (4+) | HEL (+/−) |
| MPL-TPO-R | 092517-H02 | 11543 | HEL(+) | |
| MPL & CD19 | 010417-U02 | 10497 | RAJI (+), NALM6 (+), HEL (+/−) | RAJI (+/−), NALM6 (+/−), HEL (3+) |
| MPL & CD19 | 010417-Y05 | 10501 | RAJI (+), NALM6 (+), HEL (+) | RAJI (+), NALM6 (2+), HEL (2+) |
| MPL & CD19 | 010417-W08 | 10499 | RAJI (+), NALM6 (+), HEL (+) | |
| NYBR1 | 112916-C01 | 1334 | U266 (+/−), L363 (+) | L363 (+/−), U266 (2+) |
| NY-ESO1/MHC I | 040416-D01 | 4877 | SKMEL37 (+) | MEL624 (2+) |
| NY-ESO1/MHC I | 101817-E05 | 10869 | U266(+/−) | |
| PDL1 | 101916-N07 | 1339 | L428 (+) | |
| PDL1 | 100516-N03 | 1762 | L428 (+/−) | |
| PTK7 | 071217-D03 | 10574 | HepG2 (+/−) | |
| ROR1 | 100615-E04 | 1348 | Jeko1 (+), Jurkat (2+), U266 (+) | |
| TCRgd | 022817-U05 | 1359 | Jurkats-TCRgd-SIR | |
| TERT/MHC I | 050316-A01 | 4902 | LNCAP (+/−) | MEL624 (2+), HeLa (3+) |
| Tissue Factor 1 | 021317-F07 | 11516 | LoVo (+/−) | |
| TGFBetaR2 | 063016-Z04 | 1362 | MT-4 (+/−) | |
| Tim1 | 112916-A01 | 1363 | SKOV3 (+) | SKOV3 (2+) |
| TnAg | 080816-H06 | 2003 | L428 (+/−) | Peerl (3+), Jurkat (3+) |
| TROP2 | 062816-S01 | 1367 | PC3 (4+) | |
| TSHR | 080816-G03 | 2010 | TT (+/−) | TT (+/−) |
| TSLRP | 010716-H05 | 1373 | KG1 (+), MOLM13 (2+) | |
| TSLRP | 032216-D08 | 1373 | RAJI (+) | |
| TSLRP | 091216-C03 | 1797 | Jurkat (+/−) | |
| WT1/MHC I | 111815-C04 | 4710 | U266 (+), Bv173 (+), BC1 (+) | L363 (5+), U266 (5+) |
| WT1/MHC I | 041816-Z02 | 1116 | U266 (+/−), L363 (+/−) | |
| WT1/MHC I | 091216-I03 | 1804 | U266 (+/−), L363 (+/−) | L363 (+/−), U266 (+/−) |
| WT1/MHC I | 091216-J03 | 1805 | U266 (+/−), L363 (+/−) | L363 (+/−), U266 (+−) |
| ALK | 080816-F04 | 1841 | | LAN5 (3+) |
| EGFRVIII | 090616-D03 | 1902 | | HeLa-EGFRVIII (+) |
| GD2 | 091216-F08 | 1903 | | SKMEL31 (2+) |
| TCRB2 | 090716-A07 | 1121 | | Jurkat-PSCA-M05 (+) |
| TCRB2 | 090216-Y02 | 1125 | | Jurkat-PSCA-M05 (+) |
| CD123 | 110116-I08 | 2085 | | Bv173 (2+) |
| CGH | 091616-R03 | 1735 | | MCF7 (2+) |
| CD138 | 021916-R04 | 1139 | | |
| LAMP1 | 092916-E05 | 10086 | | L363 (4+), U266 (4+) |
| CD5 | 083016-F02 | 1852 | | CEM (+) |
| CD19 | 040416-C01 | 1096 | | NALM6 (+) |
| CD19 | 112116-W08 | 10486 | | NALM6 (+) |
| CD19 | 112116-U08 | 10485 | | NALM6 |
| CD22 | 092216-C04 | 1645 | | RAJI (+), NALM6 (2+) |
| CS1 | 102016-K01 | 1646 | | L363 (3+), U266 (+/−) |
| MPL | 102016-C06 | 1960 | | HEL (2+) |
| NKG2D | 110716-B07 | 1333 | | RS411 (+) |
| CLEC5A | 050516-S06 | 1247 | | Kasumi (2+) |
| CD33 | 102016-E04 | 1865 | | HL60 (2+) |
| CD33 | 110116-C01 | 2080 | | HL60 (4+) |
| CLL1 | 102016-H04 | 1885 | | HL60 (3+) |
| CLL1 | 102016-F05 | 1884 | | HL60 (+) |
| CLL1 | 012317-F02 | 11499 | | HL60 (3+) |
| CLL1 | 012317-G05 | 11500 | | HL60 (2+) |
| CLL1 | 012317-H02 | 11501 | | HL60 (3+) |
| CD324 | 071516-F03 | 1240 | | MCF7 (3+) |

TABLE 10A-continued

Summary of NFAT-GFP and T-Cell Cytotoxicity Assays With
A Diverse Pool of SIRS Targeting Different Antigens

| Positive Target | CLONE ID# | SEQ ID DNA | NFAT-GFP ASSAY Positive Cell lines | T-CELL Cytotoxicity Assay Positive cell line |
|---|---|---|---|---|
| CD324 | 071516-L04 | 1239 | | MDAMB231 (5+) |
| SSEA | 112916-B03 | 1353 | | |
| EGFR | 062916-G04 | 1880 | | HeLa (3+) |
| GD3 | 042816-A04 | 1697 | | MEL624(+) |
| gp100/MHC I | 031516-B03 | 4828 | | MEL624(2+) |
| Tyrosinase/MHC I | 032816 B03 | 4915 | | MEL624(2+) |
| Muc1 | 050316-B01 | 4870 | | MDAMB231 (3+) |
| Muc1 | 021616-B05 | 1751 | | MDAMB231 (5+) |
| MART1 | 021216-N03 | 1739 | | MEL624(+) |
| hTERT | 021216-L07 | 1784 | | HeLa (2+) |
| TCRB12 | 072816-L06 | 1128 | | Jurkat-PSCA-M05 (2+) |
| TCRB13 | 072816-K06 | 1129 | | Jurkat-PSCA-M05 (2+) |
| TCRB1 | 030816-B07 | 1779 | | Jurkat (5+) |
| TCRB1 | 030816-D04 | 1778 | | |
| CD123 and MPL | 022516-M08 | 4591 | | HEL (4+), Bv173 (4+) |
| Ig Fc | 020416-A08 | 1186 | | RAJI + Rituximab (4+) |
| CXCR4 and CD19 | 101415-V01 | 1171 | | THP1 (4+) |
| CD33 | 090116-C02 | 1650 | | HL60 (5+) |
| CD33 | 083116-C06 | 1865 | | HL60 (2+) |
| WT1/MHC I | 012816-G01 | 4709 | | L363 (+/−), U266 (+/−) |
| NKG2D Ligand | 042916-A06 | 1755 | | MV411 (3+) |
| FLT3 | 050316-C01 | 1273 | | MV411 (3+), RS411 (4+) |
| CD19 | 031516-K04 | 940 | | MV411 (+) |
| TSHR | 042916-E03 | 1795 | | Peer1 (+), Jurkat (2+) |
| TnAg | 050216-A04 | 1788 | | Peer1 (+), Jurkat (+) |
| CD38 and BCMA | 080817-B09 | 10576 | | L363 (3+), U266 (3+) |
| LAMP1 | 050216-F05 | 1732 | | THP1 (4+) |
| CLL1 | 021216-I03 | 1250 | | THP1 (+), HL60 (2+) |
| CLL1 | 012616-A05 | 4790 | | HL60 (3+) |
| CS1 | 012716-A02 | 1254 | | L363 (4+), U266 (4+) |
| CD19 | 021916-Q03 | 1038 | | |
| CD19 | 082815-P08 | 4503 | | RAJI (2+) |
| Lym1 | 012716-B01 | 1185 | | Kasumi (5+) |
| CD19 | 100815-B04 | 951 | | RAJI (2+) |
| CD19 | 080815-B06 | 953 | | RAJI (+) |
| CD19 | 080815-F02 | 922 | | |
| CD19 | 031616-B05 | 1019 | | RAJI (4+) |
| CD19 | 031616-C05 | 1020 | | RAJI (2+) |
| CD19 | 021816-N02 | 1016 | | RAJI (2+) |
| CD19 | 020416-A02 | 1056 | | RAJI (+) |
| CD19 | 022216-A04 | 920 | | RAJI (2+) |
| CD19 | 031416-A18 | 998 | | RAJI (2+) |

To demonstrate the ability to generate a diverse pool of SIRs containing the same antigen binding domain, Jurkat-NFAT-GFP cells stably expressing SIRs containing the FMC63 based antigen binding domain but different TCR chains and linkers were compared for their ability to 1) bind CD19-GGSG-NLuc-AcV5 fusion protein (i.e. an assay for antigen binding); 2) induce GFP expression upon 18 hour co-culture with RAJI cells (i.e. an assay of cell signaling); 3) induce IL2 production upon 18 hour co-culture with RAJI cells (i.e. an assay of cytokine production); 4) stain with APC-conjugated Protein-L (i.e. a measure of cell surface expression). Results are summarized in Table 10B and demonstrate a huge diversity among the SIRs with the same antigen binding domain in the above assays. The construct SEQ ID NO:992 that contains the TCRα and TCRβ chains encoded by their wild-type nucleotide sequences showed the lowest level of CD19-GGSG-NLuc binding, GFP induction and Protein L staining. Jurkat-NFAT-GFP cells stably expressing the CD8SP-FMC63(vL-vH)-Myc-BBzT2A-PAC (SEQ ID NO: 4501) CAR was included for comparison in assays of IL2 production and Protein-L staining. Remarkably, the CAR showed markedly higher IL2 production (1159 µg/ml) and Protein-L staining (61%) as compared to all the SIRs.

TABLE 10B

Diversity among the SIRs targeting CD19 and containing the FMC63 binding domain

| SEQ ID | Name | CD19-GGSG-NLuc (RLU) | NFAT-GFP (%) | IL2 (pg/ml) | Prt-L-APC (%) |
|---|---|---|---|---|---|
| 1200 | CD8SP-FMC63-vL-V5-[hTCRb-KACIAH]-F-P2A-SP-FMC63-vH-Myc-[hTCRa-CSDVP]-F-F2A-PAC | 6844 | 8.85 | 0 | 5 |
| 922 | CD8SP-FMC63-vL-V5-[hTCRb-WT]-F-P2A-SP-FMC63-vH-Myc-[hTCRa-WT]-F-F2A-PAC | 768 | 0 | | 0 |
| 4741 | CD8SP-FMC63-vL-[hTCRb-opt2]-F-P2A-SP-FMC63-vH-[hTCRa-opt2]-F-F2A-PAC | 1317 | 5.24 | 0 | 16 |
| | CD8SP-FMC63-vL-[TCRb-S57C]-opt-F-P2A-SP-FMC63-vH-GSG-[TCRa-T48C]-opt-F-F2A-PAC | 6297 | 6.1 | 0 | 4 |
| | CD8SP-FMC63-vL-[TCRb-S57C-opt]-F-P2A-SP-FMC63-vH-[TCRa-T48C]-opt-F-F2A-PAC | 6750 | 6.3 | 0 | |
| 10479 | CD8SP-FMC63-vL-V5-[hTCRb-KACIAH]-F-P2A-SP-FMC63-vH-[GSG-hTCRa-T48C-opt]-F-F2A-PAC | 20532 | 18.8 | 0 | 20 |
| 10487 | CD8SP-FMC63-vL-V5-[hTCRb-KACIAH]-F-P2A-SP-FMC63-vH-Myc4-[hTCRα-SD]-F-F2A-PAC | 2663 | 3.62 | 0 | |
| | CD8SP-FMC63-vL-GSG-[TCRb-S57C-opt]-F-P2A-SP-FMC63-vH-GSG-[TCRa-T48C-opt]-F-F2A-PAC | 10814 | 11.8 | 0 | |
| 10481 | CD8SP-FMC63-vL-[hTCRb-S57C-opt]-F-P2A-SP-FMC63-vH-Myc-[hTCRa-CSDVP]-F-F2A-PAC | 2175 | 1.73 | 0 | |
| 10480 | CD8SP-FMC63-vL-V5-[hTCRb-KACIAH]-F-P2A-SP-FMC63-vH-[hTCRa-T48C-opt]-F-F2A-PAC | 10838 | 13.5 | 0 | 10 |
| 10482 | CD8SP-FMC63-vL-[hTCRb-R18A22]-F-P2A-SP-FMC63-vH-Myc4-[hTCRa-SD]-F-F2A-PAC | 7570 | 4.62 | 0 | |
| 10483 | CD8SP-FMC63-vL-Myc2-[hTCRb-R18A22]-F-P2A-SP-FMC63-vH-Myc4-[hTCRa-SD]-F-F2A-PAC | 4475 | 1.78 | 0 | |
| 10485 | CD8SP-FMC63-vL-[hTCRb-R18]-F-P2A-SP-FMC63-vH-Myc4-[hTCRa-SD]-F-F2A-PAC | 3912 | 0.96 | 0 | |
| 10488 | CD8SP-FMC63-vL-[hTCRb-RC]-F-P2A-SP-FMC63-vH-[hTCRa-CSDVP]-F-F2A-PAC | 12562 | 13.2 | 0 | 24 |
| 10489 | CD8SP-FMC63-vL-hTCRb-RC-F-P2A-SP-FMC63-vH-[hTCRa-CSDVP]-F-F2A-PAC | 43741 | 19.6 | 0 | 23 |
| 10490 | CD8SP-FMC63-vL-GSG-hTCRb-RAC-F-P2A-SP-FMC63-vH-Myc-[hTCRa-CSDVP]-F-F2A-PAC | 17183 | 13.9 | 56 | 14 |
| 10511 | CD8SP-FMC63-vL-[hTCRb-KACIAH]-F-P2A-SP-FMC63-vH-[hTCRa-CSDVP]-F-F2A-PAC | 9765 | 5.44 | 0 | |
| 10512 | CD8SP-FMC63-vL-[hTCRa-CSDVP]-F-F2A-SP-FMC63-vH-[hTCRb-KACIAH]-F-P2A-PAC | 21275 | 21.1 | 0 | 3 |
| 10476 | CD8SP-FMC63-vL-PG4SP-v2-[hTCRb-KACIAH]-F-P2A-SP-FMC63-vH-PG4SP-[hTCRa-CSDVP]-F-F2A-PAC | 53730 | 24.1 | 0 | 3 |
| 10477 | CD8SP-FMC63-vL-E-Coil-[hTCRb-KACIAH]-F-P2A-SP-FMC63-vH-K-coil-[hTCRa-CSDVP]-F-F2A-PAC | 35748 | 15.8 | 0 | 4 |
| 10478 | CD8SP-FMC63-vL-EAAAK-[hTCRb-KACIAH]-F-P2A-SP-FMC63-vH-EAAAK-v2-[hTCRa-CSDVP]-F-F2A-PAC | 68459 | 18.8 | 0 | 4 |
| 10554 | CD8SP-FMC63-vL-TCRb-KAC-ECD-Bam-CD3zECDTMCP-opt-F-P2A-SP-FMC63-vH-hTCRa-CSDVP-ECDn-CD3zECDTMCP-opt2-F-F2A-PAC | 9008 | 21.2 | 0 | 2 |
| 10555 | CD8SP-FMC63-vL-TCRb-S57C-ECD-Bam-CD3zECDTMCP-opt-F-P2A-SP-FMC63-vH-hTCRa-T48C-ECDn-CD3zECDTMCP-opt2-F-F2A-PAC | 6564 | 25.6 | 114 | 3 |
| 10556 | CD8SP-FMC63-vL-TCRbECD-Bam-CD3zECDTMCP-opt-F-P2A-SP-FMC63-vH-hTCRaECDn-CD3zECDTMCP-opt2-FF2A-PAC | 4298 | 20.2 | 0 | 3 |

TABLE 10B-continued

Diversity among the SIRs targeting CD19 and containing the FMC63 binding domain

| SEQ ID | Name | CD19-GGSG-NLuc (RLU) | NFAT-GFP (%) | IL2 (pg/ml) | Prt-L-APC (%) |
|---|---|---|---|---|---|
| 10492 | CD8SP-hu-FMC65-1-vL-[hTCRb-E15C]-F-P2A-SP-hu-FMC65-1-vH-[hTCRa-S15C] | 2040 | 2.48 | 0 | 8 |
| 10493 | CD8SP-hu-FMC65-1-vL-[hTCRb-D59C]-F-P2A-SP-hu-FMC65-1-vH-[hTCRa-T45C] | 3372 | 1.35 | 0 | 9 |
| 10494 | CD8SP-hu-FMC65-1-vL-[hTCRb-S77C]-F-P2A-SP-hu-FMC65-1-vH-[hTCRa-T45C] | 2174 | 0.9 | 0 | 7 |
| 10495 | CD8SP-hu-FMC65-1-vL-[hTCRb-S17C]-F-P2A-SP-hu-FMC65-1-vH-[hTCRa-Y10C] | 2628 | 1.99 | 0 | 0 |

Diversity Among Sirs Targeting The Same Antigen But Containing Different Antigen Binding Domains. To generate SIRs against a particular target with even greater diversity, several SIRs targeting CD19 were generated using antigen binding domains derived from different antibodies. These SIRs also differed in their TCR chains, linkers and the format of antigen binding domains. The corresponding CARs (i.e. the CARs containing the same antigen binding domain as present in the SIR were also generated). The different SIRs and CARs were stably transduced into Jurkat-NFAT-GFP cells and the resulting cells compared for their ability to bind to CD19-GGSG-NLuc-AcV5 and activate NFAT signaling upon overnight co-culture with RAJI cells. Table 10C demonstrates significant diversity among the different SIRs and CARs containing different CD19 antigen binding domains for their ability to bind to CD19 and activate NFAT signaling upon exposure to target cells. A Bu12 antibody based SIR CD8SP-CD19Bu12-vL-V5-[hTCRb-WT]-F-P2A-CD19Bu12-vH-Myc-[hTCRα-WT]-F-F2A-PAC (SEQ ID NO: 1038) that contains the wild-type nucleotide sequences of TCRα and TCRβ chains showed very little CD19 binding and the lowest NFAT signaling. There was also a huge difference among the different SIRs in their ability to bind CD19 and activate NFAT signaling and these two parameters were not directly correlated when compared among SIRs containing different antigen binding domains. Thus, the SIR represented by SEQ ID NO: 11240 showed nearly 10-fold higher CD19-NLuc-AcV5 binding as compared to SIRs represented by SEQ ID NOs: 10815 and 11245 but lower NFAT-signaling. These results demonstrate the ability to generate immune effector cells expressing a pool of SIRs with diverse properties for a generating a diverse adoptive immune response. The immune effector cells expressing the SIRs can be combined with immune cells expressing CARs and other chimeric immune receptors for generating even a more diverse immune response.

TABLE 10C

Diversity among the SIRs and CARs targeting CD19 and containing different antigen binding domains

| SEQ ID | Name | CD19-GGSG-NLuc (RLU) | NFAT-GFP (%) |
|---|---|---|---|
| 4503 | CD8SP-CD19BU12(vL-vH)-MYC-BBz-PAC | 30195 | 30.16 |
| 1038 | CD8SP-CD19Bu12-vL-V5-[hTCRb-WT]-F-P2A-CD19Bu12-vH-Myc-[hTCRa-WT]-F-F2A-PAC | 3272 | 4.49 |
| 10815 | CD8SP-CD19-hu-mROO5-vL-[hTCRa-CSDVP]-F-F2A-SP-CD19-hu-mROO5-vH-[hTCRb-KACIAH]-F-P2A-PAC | 2974 | 52.36 |
| 11245 | CD8SP-CD19-hu-mROO5-vL-[hTCRb-KACIAH]-F-P2A-SP-CD19-hu-mROO5-vH-[hTCRa-CSDVP]-F-F2A-PAC | 4010 | 71.81 |
| 10573 | CD8SP-pre-TCRa-del48-F-F2A-CD8SP-CD19-hu-mROO5-1-scFv-V5-[hTCRb-S57C-opt]-F-P2A-Pac | 624 | 6.77 |
| 11479 | CD8SP-V5-[hTCRb-KACIAH]-F-P2A-CD8SP-CD19-hu-mROO5-vL-Gly-Ser-Linker-CD19-hu-mROO5-vH-Myc-[hTCRa-CSDVP]-F-F2A-PAC | 952 | 9.55 |
| 11240 | CD8SP-CD19-MOR0028-vL-Myc2-[hTCRb-KACIAH]-F-P2A-SP-CD19-MOR0028-vH-Myc4-[hTCRa-CSDVP]-F-F2A-PAC | 50034 | 31.59 |
| 17702 | CD8SP-hCD19-EUK5-13-MYC-CD8TM-BBZ-XS-T2A-Pac | 3093 | 53.28 |
| 11526 | CD8SP-V5-[hTCRb-KACIAH]-F-P2A-CD8SP-hCD19-EUK5-13-vL-Gly-Ser-Linker-hCD19-EUK5-13-vH-Myc-[hTCRa-CSDVP]-F-F2A-PAC | 14564 | 6.67 |

SIR show lower antigen binding as compared to a CAR but comparable NFAT signaling. Jurkat-NFAT-GFP cells expressing a SIR CD8SP-FMC63-vL-V5-[hTCRb-KACIAH]-F-P2A-SP-FMC63-vH-Myc-[hTCRa-CSDVP]-F-F2A-PAC (010616-C01) [SEQ ID NO:1200] and a CAR CD8SP-FMC63(vL-vH)-Myc-BBz-T2A-PAC (112014-A13) [SEQ ID NO:4501] are tested together with the parental Jurkat-NFAT-GFP cells for induction of NFAT induced GFP expression following overnight exposure to RAJI cells. The cells expressing the SIR (SEQ ID NO: 1200) and the CAR (SEQ ID NO: 4501) are shown to induce comparable and significantly higher GFP induction as compared to the parental cells demonstrating effective induction of NFAT signaling by both the SIR and the CAR. The cells are subsequently tested in triplicate for antigen binding using CD19-GGSG-NLuc binding assay. The mean NLuc binding activities with the parental Jurkat cells is 93 while Jurkat cells expressing the SIR (SEQ ID NO: 1200) and the CAR (SEQ ID NO: 4501) show mean NLuc values of 16422 and 186567, respectively. Thus, Jurkat cells expressing the SIR SEQ ID NO: 1200 which has nearly equivalent NFAT signaling activity as the corresponding CAR (SEQ ID NO: 4501) when both are exposed to the target antigen show nearly 10-fold lower antigen binding affinity.

Figure 16:
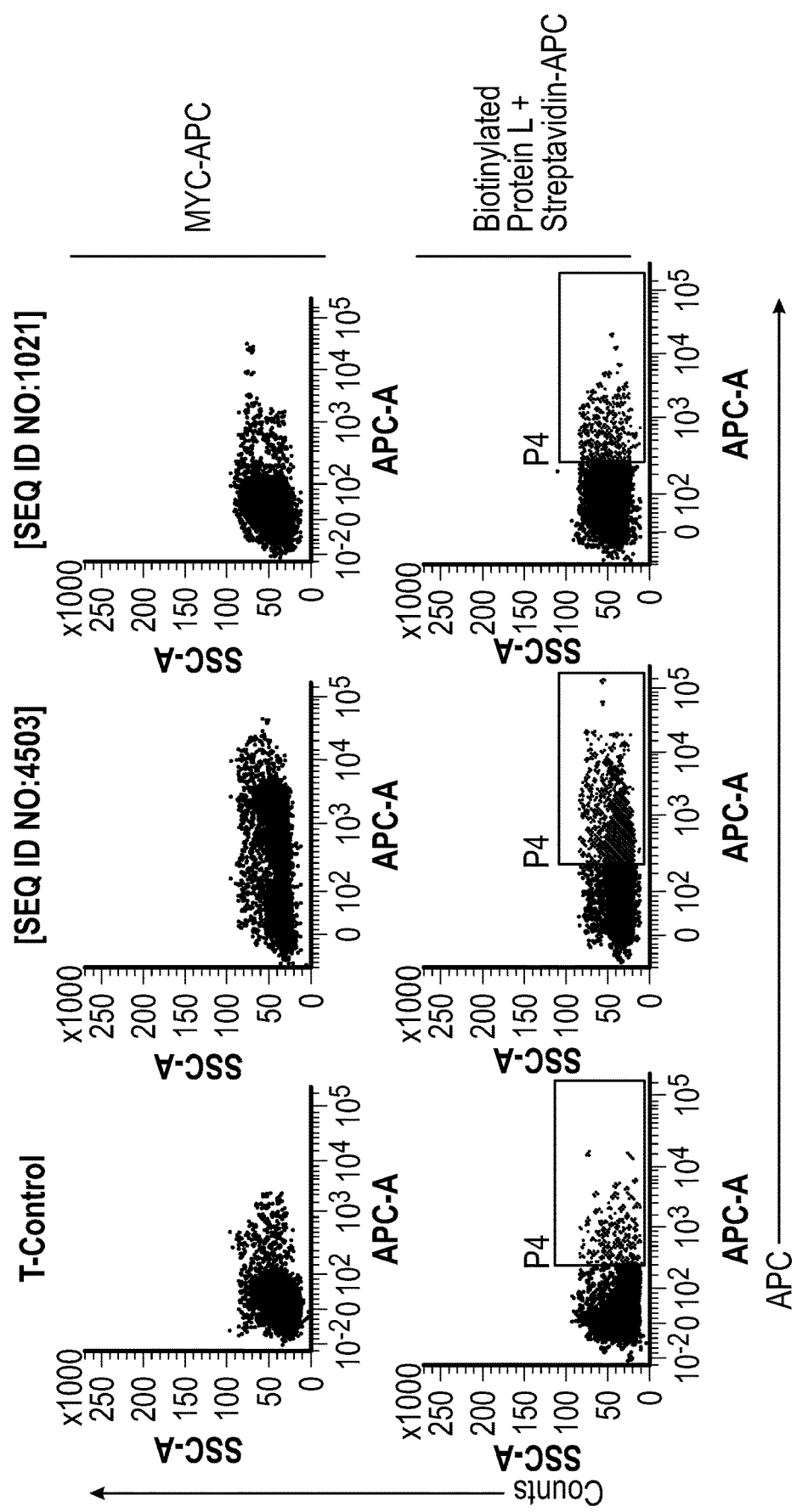
FIG. 16 shows lower cell surface expression of a Bu12 SIR (CD8SP-CD19Bu12-vL-V5-[TCRb-S57C-opt1]-F-P2A-SP-CD19Bu12-vH-Myc-[TCRa-T48C-opt1]-F-F2A-PAC (070215-M03) [SEQ ID NO:1021] as compared to a Bu12 CAR CD8SP-CD19Bu12-(vL-vH)-Myc-BBz-T2A-PAC (082815-P08) [SEQ ID NO: 4503] on T cells as determined by staining with APC-MYC-APC and Biotin-Protein-L plus APC-Streptavidin, respectively.

A Bu12 based SIR shows significantly lower cell surface expression as compared to a comparable Bu12 CAR. Increased expression of CAR on the surface of T cells is known to lead to self-aggregation, tonic signaling and early exhaustion of the cells. Human peripheral T cells were infected with lentiviruses encoding a Bu12 based SIR (CD8SP-CD19Bu12-(vL-vH)-Myc-BBz-T2A-PAC (SEQ ID NO: 4503) and a comparable CAR (CD8SP-CD19Bu12-vL-V5-[TCRb-S57C-opt1]-F-P2A-SP-CD19Bu12-vH-Myc-[TCRa-T48C-opt1]-F-F2A-PAC (070215-M03) [SEQ ID NO:1021] targeting CD19. The cells were selected with puromycin and expanded. T cells expressing the SIR and the CAR showed effective cytotoxicity against RAJI-GLuc cells. The T cells were also examined for cell surface expression of the SIR and the CAR using staining with antibody against the Myc tag and with biotinylated Protein L followed by APC-conjugated streptavidin Protein L. FIG. 16 shows that T cells expressing the SIR (SEQ ID NO: 1021) show significantly lower cell surface expression as compared to the T cells expressing the corresponding CAR (SEQ ID NO: 4503) when measured by either method.

SIR-T cells show lower TNFα production as compared to corresponding CAR-T cells. T cells are engineered to express a CAR CD8SP-FMC63-vL-Gly-Ser-Linker-FMC63-vH-Myc-CD8TM-BBz (SEQ ID NO: 9659) and a corresponding SIR (CD8SP-FMC63-vL-[hTCRa-CSDVP]-F-F2A-SP-FMC63-vH-[hTCRb-KACIAH]-F-P2A-PAC (SEQ ID NO: 10596). The cells are co-cultured with Nalm6 and BV173 target cell line for 24 hours at 37° C. and induction of TNFα production is measured by ELISA. CAR-expressing T cells are shown to result in greater fold increase in TNFα production as compared to SIR-T cells. Both SIR-T and CAR-T cells are shown to induce significant cytotoxicity against the target cell lines.

Use of two vectors to express a SIR. In the preceding experiments, the two functional polypeptide units (FPU) of a SIR were expressed using a single vector. Next, it was tested if the two FPU of the SIR can be expressed using two different vectors. The SIR lentiviral constructs 050216-T02 and 050216-S08 contain the SIR sequence corresponding to SEQ ID NO: 913 encoding the SIR fragment CD8SP-FMC63-vL-V5-[hTCRb-KACIAH]-F-P2A-PAC in which the vL fragment derived from CD19 monoclonal antibody FMC63 is joined to the constant chain of hTCRb with KACIAH mutations via a V5 linker. This SIR FPU is connected via a F-P2A cleavable linker to PAC (puromycin resistance) gene. The vector for the 050216-T02 construct is pLenti-EF1α-DWPRE (SEQ ID NO: 871), while the vector for 050216-S08 is pLenti-EF1α (SEQ ID NO: 870). The SIR lentiviral constructs 041916-A02 and 041916-B03 contain the SIR sequence corresponding to SEQ ID NO: 997 encoding the SIR fragment CD8SP-FMC63-vH-MYC-[TCRa-CSDVP]-F-F2A-BlastR in which the vH fragment derived from CD19 monoclonal antibody FMC63 is joined to the constant chain of hTCRa with CSDVP mutations via a MYC linker. This SIR FPU is connected via a F-F2A cleavable linker to a blasticidin resistance gene. The vector for the 041916-A02 construct is pLenti-EF1α-DWPRE (SEQ ID NO: 871), while the vector for the 041916-B03 is pLenti-EF1α (SEQ ID NO: 870). Jurkat-NFAT-GFP cells were infected with the 050216-S08 and selected with puromycin. Jurkat-NFAT-GFP cells were also infected with the 041916-A02 and 041916-B03 constructs and selected with blasticidin. Finally, Jurkat-NFAT-GFP cells were infected with 050216-S08 and upon selection with puromycin, infected with either 041916-A02 or 041916-B03 constructs and selected with blasticidin to select cells that express both FPU of the SIR. The singly or doubly infected cells were tested for binding to CD19-GGS-Nluc using the NLuc-binding assay. The results showed that Jurkat-NFAT-GFP cells infected with the constructs 050216-S08[SEQ ID NO: 913], 041916-A02[SEQ ID NO: 997] or 041916-B03[SEQ ID NO: 997] constructs alone do not show any significant binding with CD19-GGS-NLuc. In contrast, Jurkat-NFAT-GFP cells infected with the constructs 050216-S08 plus 041916-A02[SEQ ID NO: 997] and 050216-S08[SEQ ID NO: 913] plus 041916-B03[SEQ ID NO: 997] showed strong binding to CD19-GGS-NLuc. The Jurkat-NFAT-GFP cells infected with the constructs 050216-S08[SEQ ID NO: 913] plus 041916-A02[SEQ ID NO: 997] and 050216-S08 [SEQ ID NO: 913] plus 041916-B03[SEQ ID NO: 997] also showed strong induction of GFP expression when cocultured with the RAJI target cells while the Jurkat-NFAT-GFP cells infected with the constructs singly failed to do so. These results demonstrate that the two FPU of a SIR can be expressed using two different vectors and can assemble to make a functional receptor in the doubly infected cell. The exemplary SIR constructs that express different vL fragments of the disclosure joined to TCRb chains (hTCRb-S57C-opt) via a V5 linker are represented by DNA SEQ ID NOs:8803 to 8978 and 17162 to 17277 and PRT SEQ ID NOs: 9231-9406 and 17396 to 17511. The exemplary corresponding SIR constructs that express different vH fragments of the disclosure joined to TCRa chains (hTCRa-T48C-opt) via a Myc linker are represented by DNA SEQ ID NOs: 9017 to 9191 and 17279-17394 and PRT SEQ ID NOs: 9445 to 9619 and 17513 to 17628.

Use of retroviral vectors for expression of SIR. A number of SIR inserts were cut out of the lentiviral vectors by digestion with Nhe I and Sal I enzymes and subcloned into AvrII and Sal I digested retroviral vector MSCV-Bgl2-AvrII-Bam-EcoR1-Xho-BstB1-Mlu-Sal-ClaI.I03 (SEQ ID NO: 872). The Clone ID, SEQ ID and names of the inserts are shown in the following Table 11.

TABLE 11

Table: SIR constructs in MSCV based Retroviral Vector

| CLONE ID | SEQ ID | NAME |
| --- | --- | --- |
| 032216-Q05 | 1410 | CD8SP-FMC63-vL-V5-[hTCRb-KACIAH]-F-P2A-SP-FMC63-vH-Myc-[preTCRa-Del48]-F-F2A-PAC |
| 032416-M07 | 4741 | CD8SP-FMC63-vL-[hTCRb-opt2]-F-P2A-SP-FMC63-vH-[hTCRa-opt2]-F-F2A-PAC |
| 032216-N01 | 992 | CD8SP-FMC63-vL-V5-[hTCRb-KACIAH]-F-P2A-SP-FMC63-vH-Myc-[hTCRa-CSDVP]-F-F2A-PAC |
| 032216-C04 | 1212 | CD8SP-BCMA-huC12A3-L3H3-vL-V5-[hTCRb-KACIAH]-F-P2A-SP-BCMA-huC12A3-L3H3-vH-Myc-[hTCRa-CSDVP]-F-F2A-PAC |
| 032216-W04 | 1230 | CD8SP-CD33-huMyc9-vL-V5-[hTCRb-KACIAH]-F-P2A-SP-CD33-huMyc9-vH-Myc-[hTCRa-CSDVP]-F-F2A-PAC |
| 032216-Y07 | 1315 | CD8SP-Lym2-vL-V5-[hTCRb-KACIAH]-F-P2A-SP-Lym2-vH-Myc-[hTCRa-CSDVP]-F-F2A-PAC |
| 032216-D08 | 1373 | CD8SP-TSLPR-vL-V5-[hTCRb-KACIAH]-F-P2A-SP-TSLPR-vH-Myc-[hTCRa-CSDVP]-F-F2A-PAC |

Figure 14:
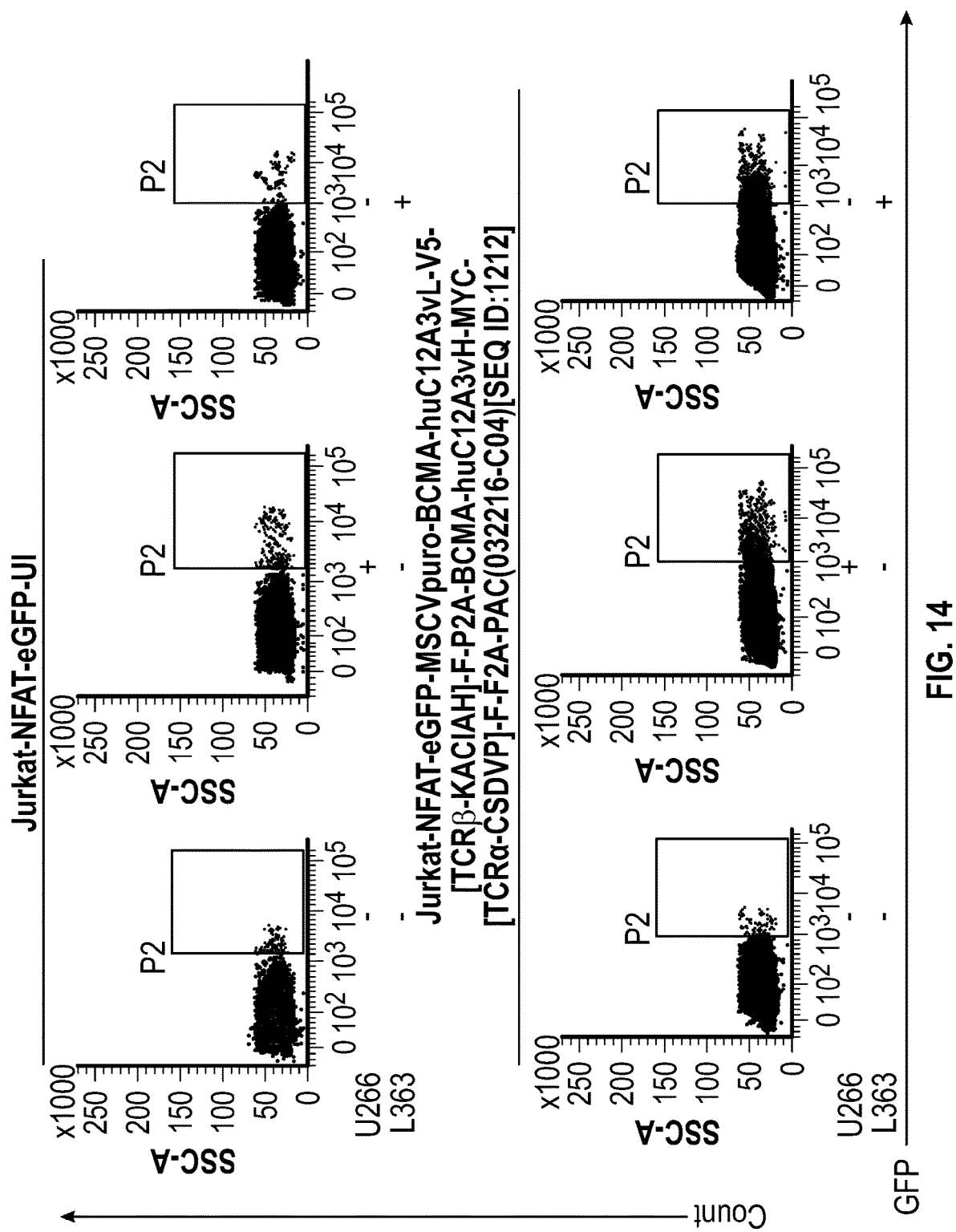
FIG. 14 shows exemplary results of retroviral vector used to express SIRS of the disclosure.

The above constructs were used to generate the corresponding retroviruses, which in turn, were used to infect the Jurkat-NFAT-GFP cells. The infected cells were selected with puromycin and used in various assays to test SIR expression and activity. The Jurkat-NFAT-GFP cells infected with the above constructs showed GFP induction upon coculture with the corresponding target cell line. These results demonstrate that retroviral vectors can be used to express the SIRs of the disclosure. The result with an exemplary construct (SEQ ID NO: 1212) are shown in FIG. 14.

Figure 15:
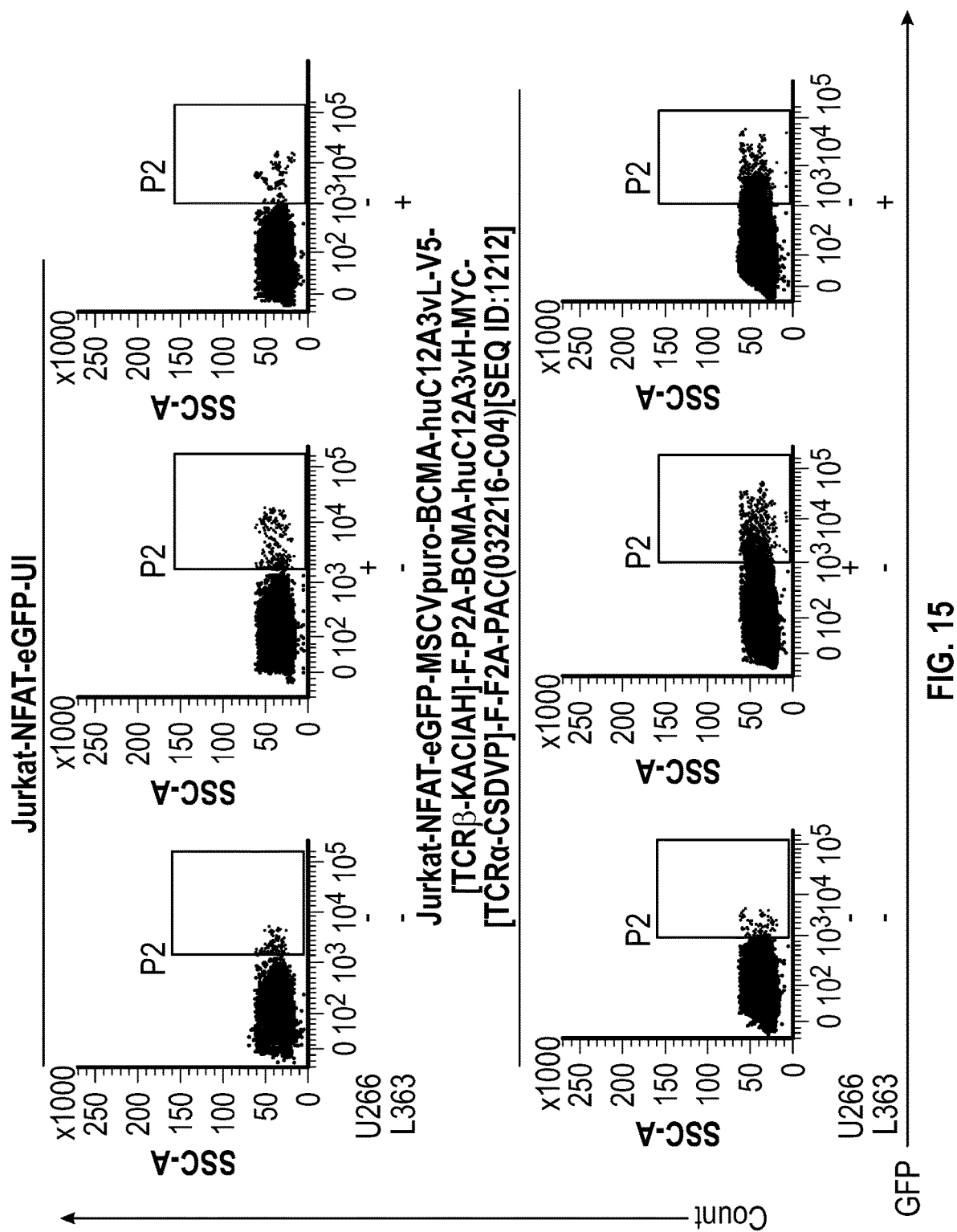
FIG. 15 shows results using a Sleeping Beauty Transposon Vector, Jurkat-NFAT-GFP cells transfected with the construct pSBbi-puro-FMC63vL-V5-[TCRb-KACIAH]-F-P2A-FMC63vH-MYC-[TCRa-CSDVP]-F-F2A [010616-B01](SEQ ID NO:875) showed GFP induction upon coculture with the corresponding RAJI target cell line.

Use of Sleeping Beauty Transposon Vector for expression of SIR. A number of SIR inserts were cut out of the lentiviral vectors by digestion with Age I and Xba I enzymes and subcloned into Age I and Xba I digested Sleeping Beauty Transposon Vector pSBbi-Pur (SEQ ID NO: 874). The resulting constructs were transfected into Jurkat-NFAT-GFP cells along with transposase encoding vector pCMV/SB10 (Addgene Plasmid #24551). Cells were selected with puromycin as above and expanded. As shown in the following FIG. 15, the Jurkat-NFAT-GFP cells transfected with the construct pSBbi-puro-FMC63vL-V5-[TCRb-KACIAH]-F-P2A-FMC63vH-MYC-[TCRa-CSDVP]-F-F2A [010616-B01](SEQ ID NO:875) showed GFP induction upon coculture with the corresponding RAJI target cell line. These results demonstrate that Sleeping Beauty Transposon can be used to express the SIRs of the disclosure.

Use of in vitro transcribed (IVT) RNA for expression of SIR. IVT to generate SIR encoding RNAs is performed essentially as described (Zhao Y, et al, MOLECULAR THERAPY Vol. 13, No. 1, 2006). The mMESSAGE mMACHINE High Yield Capped RNA Transcription Kit (Invitrogen) is utilized to generate IVT RNA. The IVT RNA was purified using an RNeasy Mini Kit (Qiagen, Inc., Valencia, CA, USA) and purified RNA is eluted in RNase-free water at 1-0.5 µg/ml. For the electroporation of unstimulated PBMCs, cells (0.1 ml) were electroporated with 5 µg of RNA encoding SIR CD8SP-FMC63-vL-V5-[hTCRb-KACIAH]-F-P2A-SP-FMC63-vH-Myc-[hTCRa-CSDVP]-F-F2A-PAC (102615-C08) [SEQ ID NO:1200] targeting CD19. Cells and cuvettes are prechilled by putting them on ice for 5 min before electroporation. Subsequently, 0.05 to 0.2 ml of the cells is mixed with 2 µg/1 $10^6$ T cells of IVT RNA (or as indicated) and electroporated in a 2-mm cuvette (Harvard Apparatus BTX, Holliston, MA, USA), using an ECM830 Electro Square Wave Porator (Harvard Apparatus BTX). Immediately after electroporation, the cells are transferred to fresh CM with 300 IU/ml IL-2 and incubated at 37° C. The cells transcribed in IVT RNA encoding SIR are assayed 48-72 h later. The SIR transfected cells show increased binding to CD19-GGS-NLuc fusion protein and increased lysis of RAJI-GLuc target cells.

In vivo efficacy of SIR targeting CD19. Human peripheral blood T cells isolated using CD3 magnetic beads were infected with lentiviruses expressing the CD8SP-FMC63-vL-V5-[hTCRb-WT]-F-P2A-SP-FMC63-vH-Myc-[hTCRa-WT]-F-F2A-PAC (080815-F02) [SEQ ID NO:922], CD8SP-FMC63-vL-V5-[mTCRb-opt]-F-P2A-SP-FMC63-vH-Myc-[mTCRa-opt]-F-F2A-PAC (080815-B06) [SEQ ID NO:953], CD8SP-FMC63-vL-V5-[hTCRb-KACIAH]-F-P2A-SP-FMC63-vH-Myc-[hTCRa-CSDVP]-F-F2A-PAC (081415-D06) [SEQ ID NO:992] SIR constructs and Gluc-PAC-G07 control construct encoding non-secretory form of Guassia Luciferase. Approximately half the cells were selected with puromycin while the other half was expanded without puromycin selection. NSG mice (Jackson Lab) were sub-lethally irradiated at a dose of 175 cGy. Approximately 24 hours post irradiation (day 2), mice were injected with 2.5×$10^4$ RAJI cells via tail-vein. On day 3, the mice (n=5 for each group) were treated with 5 million T cells (50% puromycin selected+50% unselected) that had been infected with the indicated SIR encoding lentiviruses or Gluc-PAC-G07 construct. Control mice (n=5) received no T cells or uninfected T cells. Mice were given human IL2 (400 IU intraperitoneally) on alternate days till the death of all mice in control group. Table 12 shows the survival of mice in each group. The FMC63 based SIR (080815-F02) in which both the TCRb and TCRa constant chains are encoded by their wild-type nucleotide sequence failed to confer survival, while the SIR construct (080815-B06) [SEQ ID NO:953] containing codon-optimized mouse TCRb and TCRa constant chains sequences conferred survival advantage. Similarly, the SIR construct (081415-D06) [SEQ ID NO:992] containing codon-optimized murinized human TCRb and TCRa constant chains sequences conferred survival advantage.

TABLE 12

RAJI Cells
NSG mice

| Construct | Median Survival (days) | P value |
|---|---|---|
| Control (No T cells) (n = 5) | 20 | |
| Uninfected T cells (n = 5) | 19 | |
| Gluc-PAC-G07 (n = 5) | 20 | |
| CD8SP-FMC63-vL-V5-[hTCRb-WT]-F-P2A-SP-FMC63-vH-Myc-[hTCRa-WT]-F-F2A-PAC (080815-F02) [SEQ ID NO: 922] (n = 5) | 20 | |
| CD8SP-FMC63-vL-V5-[mTCRb-opt]-F-P2A-SP-FMC63-vH-Myc-[mTCRa-opt]-F-F2A-PAC (080815-B06) [SEQ ID NO: 953] (n = 5) | 24 | 0.0027 |
| CD8SP-FMC63-vL-V5-[hTCRb-KACIAH]-F-P2A-SP-FMC63-vH-Myc-[hTCRa-CSDVP]-F-F2A-PAC (081415-D06) [SEQ ID NO: 992] (n = 4) | 24 | 0.0047 |

Human peripheral blood T cells isolated using CD3 magnetic beads were infected with lentiviruses expressing the indicated SIR constructs (040315-U02) [SEQ ID NO:1112], (050515-L05) [SEQ ID NO:900], (082815-G07) [SEQ ID NO:1620], (082815-E05) [SEQ ID NO:1622], and (091015-Y08) [SEQ ID NO:926]. Approximately half the cells were selected with puromycin while the other half was expanded without puromycin selection. NSG mice (Jackson Lab) were sub-lethally irradiated at a dose of 175 cGy. Approximately 24 hours post irradiation (day 2), mice were injected with 2.5×$10^4$ RAJI cells via tail-vein. On day 3, the mice (n=5 for each group) were treated with 5 million T cells (50% puromycin selected+50% unselected) that had been infected with the indicated SIR encoding lentiviruses. Control mice (n=5) received no T cells or uninfected T cells. Mice were given human IL2 (400 IU intraperitoneally) on alternate days till the death of all mice in control group. Table 13 shows the survival of mice in each group. The double chain FMC63 based SIR (050515-L05) [SEQ ID NO:900] in which both the TCRb and TCRa constant chains are encoded by codon optimized nucleotide sequence and carry amino acid substitutions to promote chain pairing conferred survival advantage. Importantly, the double chain SIR construct (091015-Y08) [SEQ ID NO:926] containing FMC63-vL fused to the wild-type TCRb constant chain and FMC63-vH fused to the preTCRa-Del48 chain conferred even bigger survival advantage (median survival=31 days).

The (082815-G07) [SEQ ID NO:1620] construct in which TCRb-KACIAH constant chain does not have any vL (or vH) fragment fused to it and the FMC63-derived scFV fragment (vL-linker-vH) is expressed fused to TCRa- CSDVP conferred even bigger survival advantage (median survival=34 days). Finally, the (082815-E05) [SEQ ID NO:1622] construct in which TCRb-KACIAH constant chain does not have any vL (or vH) fragment fused to it and the CD19-Bu12-derived scFV fragment (vL-linker-vH) is expressed fused to TCRa-CSDVP conferred the biggest survival advantage (median survival=36 days).

TABLE 13

RAJI Cells
NSG mice

| Construct | Median Survival (days) | P value |
| --- | --- | --- |
| Control (No T cells) (n = 5) | 22 | |
| Uninfected T cells (n = 5) | 22 | |
| CD8SP-MPL-161-vL-V5-[hTCRb-S57C-opt1]-F-P2A-MPL-161-vH-Myc-[hTCRa-T48C-opt1]-F-F2A-PAC (040315-U02) [SEQ ID NO: 1112] (n = 5) | 23 | Non-significant |
| CD8SP-FMC63-vL-V5-[TCRb-S57C-opt1]-F-P2A-SP-FMC63-vH-Myc-[TCRa-T48C-opt1]-F-F2A-PAC (050515-L05) [SEQ ID NO: 900] (n = 5) | 27 | 0.058 |
| CD8SP-FMC63-vL-V5-[hTCRb-WT]-F-P2A-SP-FMC63-vH-Myc-[preTCRa-Del48]-F-F2A-PAC (091015-Y08) [SEQ ID NO: 926] (n = 5) | 31 | 0.15 |
| CD8SP-V5-[hTCRb-KACIAH]-F-P2A-CD8SP-FMC63-vL-Gly-Ser-Linker-FMC63-vH-Myc-[hTCRa-CSDVP]-F-F2A-PAC (082815-G07) [SEQ ID NO: 1620] (n = 5) | 34 | 0.0016 |
| CD8SP-V5-[hTCRb-KACIAH]-F-P2A-CD8SP-CD19Bu12-vL-Gly-Ser-Linker-CD19Bu12-vH-Myc-[hTCRa-CSDVP]-F-F2A-PAC (082815-E05) [SEQ ID NO: 1622] (n = 5) | 36 | 0.0074 |

Human peripheral blood T cells isolated using CD3 magnetic beads were infected with lentiviruses expressing the CD8SP-FMC63-vL-V5-[TCRb-S57C-opt1]-F-P2A-SP-FMC63-vH-Myc-[TCRa-T48C-opt1]-F-F2A-PAC (050515-L05) [SEQ ID NO:900] SIR construct. NSG mice (Jackson Lab) were sub-lethally irradiated at a dose of 175 cGy. Approximately 24 hours post irradiation (day 2), mice were injected with $2.5 \times 10^4$ RAJI cells via tail-vein. On day 3, the mice (n=5 for each group) were treated with 5 million T cells that had been infected with the indicated CD8SP-FMC63-vL-V5-[TCRb-S57C-opt1]-F-P2A-SP-FMC63-vH-Myc-[TCRa-T48C-opt1]-F-F2A-PAC (050515-L05) [SEQ ID NO:900] SIR encoding lentivirus. Control mice (n=5) were injected with 5 million uninfected T cells or given no T cells. Table shows the survival of mice in each group. The median survival of mice given RAJI cells alone and uninfected T cells were 22 days. In contrast, the median survival of mice which received (050515-L05) [SEQ ID NO: 900]-SIR T cells was 27 days, which was significantly increased. Thus, infusion of T cells expressing (050515-L05) [SEQ ID NO:900]-SIR leads to significant improvement in survival of mice in this RAJI xenograft model of lymphoma as compared to mice given no T cells or those given uninfected T cells.

Figure 17:
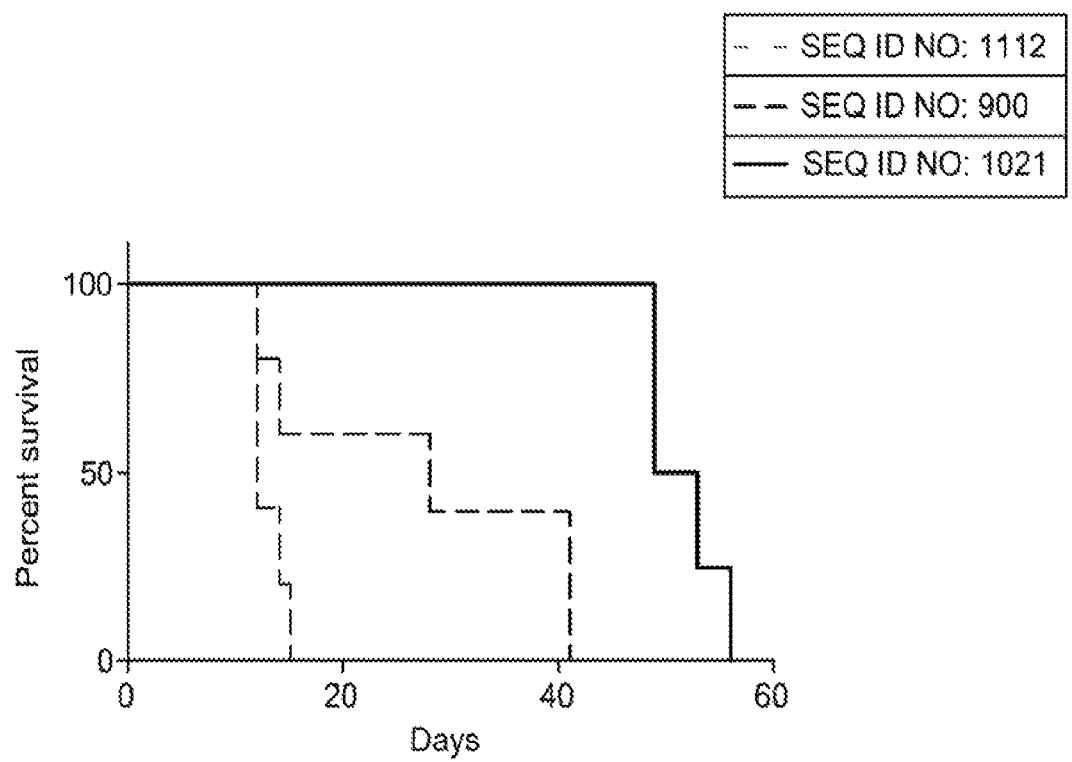
FIG. 17 shows survival of NSG mice injected with RAJI cells and receiving T cells expressing the CD19-directed SIRs CD8SP-FMC63-vL-V5-[TCRb-S57C-opt1]-F-P2A-SP-FMC63-vH-Myc-[TCRa-T48C-opt1]-F-F2A-PAC (050515-L05) [SEQ ID NO:900], and CD8SP-CD19Bu12-vL-V5-[TCRb-S57C-opt1]-F-P2A-SP-CD19Bu12-vH-Myc-[TCRa-T48C-opt1]-F-F2A-PAC (070215-M03) [SEQ ID NO:1021] as compared to MPL directed control SIR CD8SP-MPL-161-vL-V5-[hTCRb-S57C-opt1]-F-P2A-MPL-161-vH-Myc-[hTCRa-T48C-opt1]-F-F2A-PAC (040315-U02) [SEQ ID 1112].

Human peripheral blood T cells isolated using CD3 magnetic beads were infected with lentiviruses expressing the CD8SP-FMC63-vL-V5-[TCRb-S57C-opt1]-F-P2A-SP-FMC63-vH-Myc-[TCRa-T48C-opt1]-F-F2A-PAC (050515-L05) [SEQ ID NO:900] and CD8SP-CD19Bu12-vL-V5-[TCRb-S57C-opt1]-F-P2A-SP-CD19Bu12-vH-Myc-[TCRa-T48C-opt1]-F-F2A-PAC (070215-M03) [SEQ ID NO:1021] SIR constructs. T cells expressing the control SIR CD8SP-MPL-161-vL-V5-[TCRb-S57C-opt1]-F-P2A-MPL-161-vH-Myc-[TCRa-T48C-opt1]-F-F2A-PAC (040315-U02) [SEQ ID NO: 1112] SIR were included as controls. NSG mice (n=5) were sub-lethally irradiated at a dose of 175 cGy. 24 hours post irradiation (day 2), mice were injected with $2.5 \times 10^4$ RAJI cells via tail-vein. On day 3, the mice (n=5 for each group) were treated with 5 million T cells that had been infected with the indicated SIR encoding lentiviruses. Mice were given human IL2 (400 IU i.p.) on alternate days till the death of all mice in control group. FIG. 17 shows the survival of mice in each group. The median survival of mice given RAJI cells and control SIR expressing T cells (SEQ ID NO: 1112) was 12 days. In contrast, the median survival of mice which received (050515-L05) [SEQ ID NO:900]-SIR-T and (070215-M03) [SEQ ID NO:1021] SIR-T cells were 28.0 days and 51 days, which were significantly increased (p=0.0004).

Human peripheral blood T cells isolated using CD3 magnetic beads were infected with lentiviruses expressing the indicated SIR constructs targeting Folate receptor 1 (FR1), L1CAM and Epcam1. On day 1, the NSG mice were sub-lethally irradiated at a dose of 175 cGy. 24 hours post irradiation (day 2), mice were injected with $1 \times 10^6$ SKOV-3 cells intraperitoneally. On day 3, the mice were treated intravenously with 5 million indicated CAR-T cells. Beginning On day 4, mice were injected with human IL-2 i.p. at a dose of 400 IU/mice every alternate day after the injection CAR-T cells till the death of all mice in control group.

SKOV3 Cells
NSG mice (n = 3)

| Construct | Median Survival (days) |
| --- | --- |
| Control (No T cells) (n = 3) | 52 |
| Uninfected T cells (n = 3) | 52 |
| CD8SP-FR1-huMov19-vL-V5-[hTCRb-KACIAH]-F-P2A-SP-FR1-huMov19-vH-Myc-[hTCRa-CSDVP]-F-F2A-PAC (102915-P07) [SEQ ID NO: 1276] | 71 |
| CD8SP-L1CAM-9-3-HU3-vL-V5-[hTCRb-KACIAH]-F-P2A-SP-L1CAM-9-3-HU3-vH-Myc-[hTCRa-CSDVP]-F-F2A-PAC (010716-G03) [SEQ ID NO: 1312] | 63 |
| CD8SP-Epcam1-MM1-vL-V5-[hTCRb-KACIAH]-F-P2A-SP-Epcam1-MM1-vH-Myc-[hTCRa-CSDVP]-F-F2A-PAC (121815-B07) [SEQ ID NO: 1271] | 63 |
| CD8SP-Epcam1-D5K5-vL-V5-[hTCRb-KACIAH]-F-P2A-SP-Epcam1-D5K5-vH-Myc-[hTCRa-CSDVP]-F-F2A-PAC (121815-C05) [SEQ ID NO: 1272] | 63 |

Human peripheral blood T cells isolated using CD3 magnetic beads were infected with lentiviruses expressing the indicated SIR constructs targeting CS1. On day 1, the NSG mice were sub-lethally irradiated at a dose of 175 cGy. 24 hours post irradiation (day 2), mice were injected with $0.5 \times 10^6$ L363 cells intravenously. On day 3, the mice were treated intravenously with 10 million indicated CAR-T cells. Beginning on day 4, mice were injected with human IL-2 i.p. at a dose of 400 IU/mice every alternate day after the injection CAR-T cells till the death of all mice in control group.

| L363 Cells NSG mice (n = 3) | |
| --- | --- |
| Construct | Median Survival (days) |
| Control (No T cells) (n = 3) | 40 |
| Uninfected T cells (n = 3) | 40 |
| CD8SP-CS1-huLuc90-vL-V5-[hTCRb-KACIAH]-F-P2A-SP-huLuc90-vH-Myc-[hTCRa-CSDVP]-F-F2A-PAC (012716-A02) [SEQ ID NO: 1254] | 58 |

Human peripheral blood T cells isolated using CD3 magnetic beads were infected with lentiviruses expressing the indicated SIR constructs targeting Lym1 and Lym2. On day 1, the NSG mice were sub-lethally irradiated at a dose of 175 cGy. 24 hours post irradiation (day 2), mice were injected with $25 \times 10^3$ Raji cells intravenously. On day 3, the mice were treated intravenously with 10 million indicated CAR-T cells. Beginning on day 4, mice were injected with human IL-2 i.p. at a dose of 400 IU/mice every alternate day after the injection CAR-T cells till the death of all mice in control group.

| RAJI Cells NSG mice (n = 3) | |
| --- | --- |
| Construct | Median Survival (days) |
| Control (No T cells) (n = 3) | 29 |
| CD8SP-4C3-VL-V5-[TCRb-S57C-opt1]-F-P2A-SP-4C3-vH-Myc-[TCRa-T48C-opt1]-F-F2A-PAC (111815-O05) | 29 |
| CD8SP-Lym1-vL-[hTCRb-opt2]-F-P2A-SP-Lym1-vH-[hTCRa-opt2-Del]-F-F2A-PAC (012716-B01) [SEQ ID NO: 1185] | 34 |
| CD8SP-Lym2-vL-V5-[hTCRb-KACIAH]-F-P2A-SP-Lym2-vH-Myc-[hTCRa-CSDVP]-F-F2A-PAC (100615-B07) [SEQ ID NO: 1315] | 33 |

Essentially a similar experimental plan as described in the preceding examples will be used to test the in vivo efficacy of other SIR constructs described in this invention using the NSG mice and appropriate cell line expressing the target of the SIR.

Figure 18:
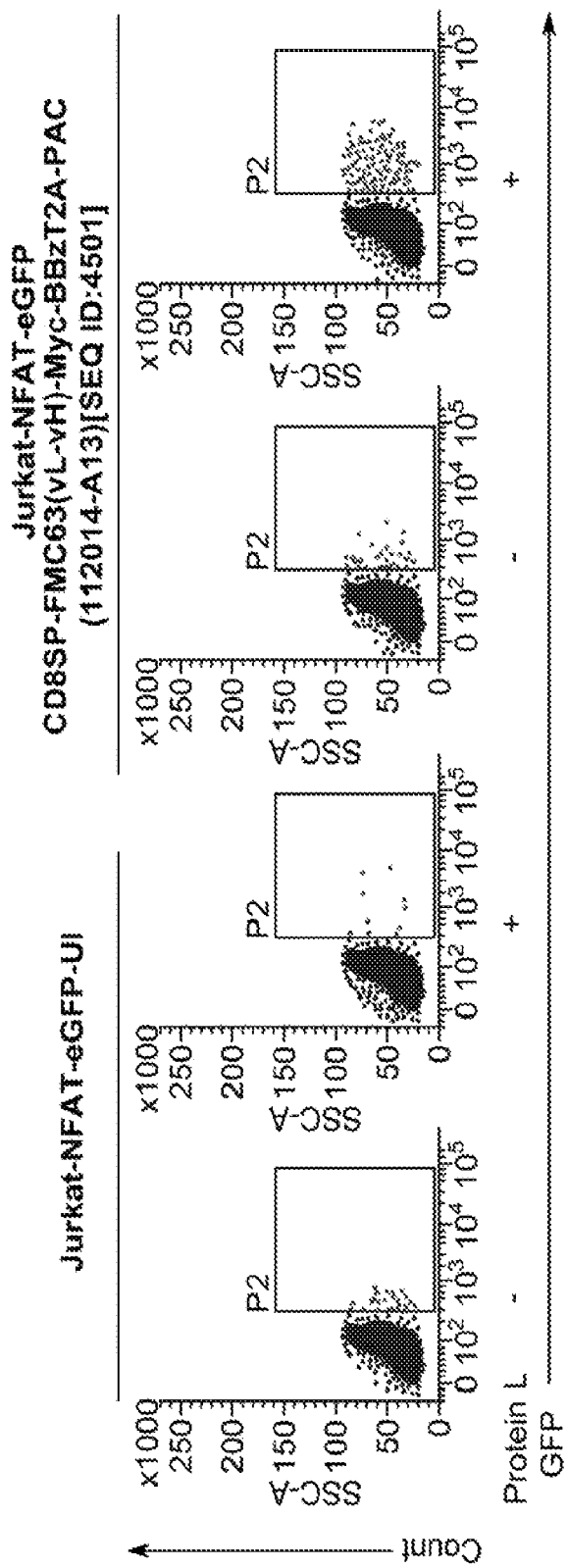
FIG. 18 shows GFP induction of by cocultures of Jurkat-NFAT-GFP cells expression a construct of the disclosure with Protein L beads.
Figure 19A:
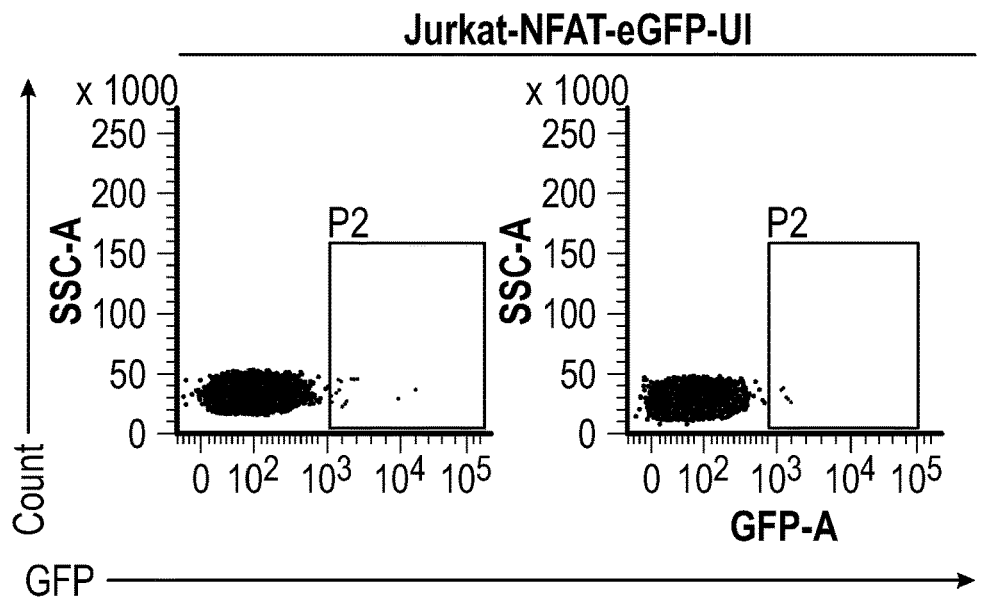
FIG. 19A-D shows co-culture with 293-Protein L-II cells led to strong induction of GFP expression in Jurkat-NFAT-GFP cells expressing (B) the CD8SP-FMC63(vL-vH)-Myc-BBz-T2A-PAC (112014-A13) [SEQ ID NO:4501] CAR, (C) CD8SP-HuLuc64-vL-V5-[hTCRb-KACIAH]-F-P2A-SP-HuLuc64-vH-Myc-[hTCRa-CSDVP]-F-F2A-PAC (092916-E07) [SEQ ID NO: 1253], and (D) CD8SP-V5-[hTCRb-KACIAH]-F-P2A-CD8SP-CD19Bu12-vL-Gly-Ser-Linker-CD19Bu12-vH-Myc-[hTCRa-CSDVP]-F-F2A-PAC (082815-E05) [SEQ ID NO:1622] SIR constructs.
Figure 19B:
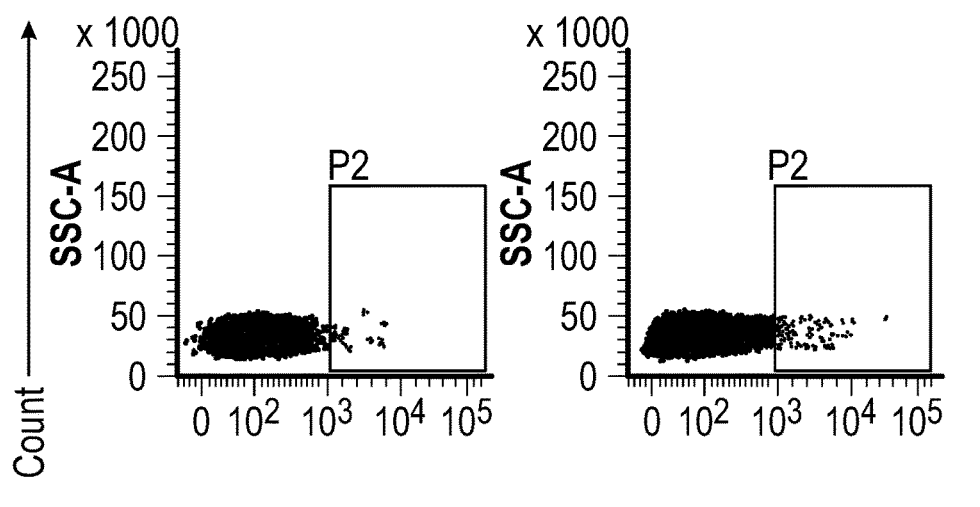
Figure 19C:
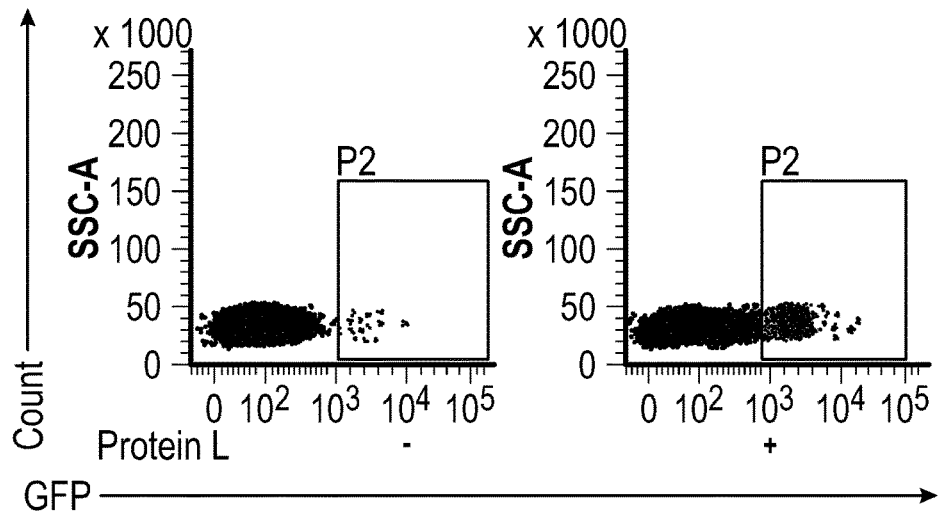
Figure 19D:
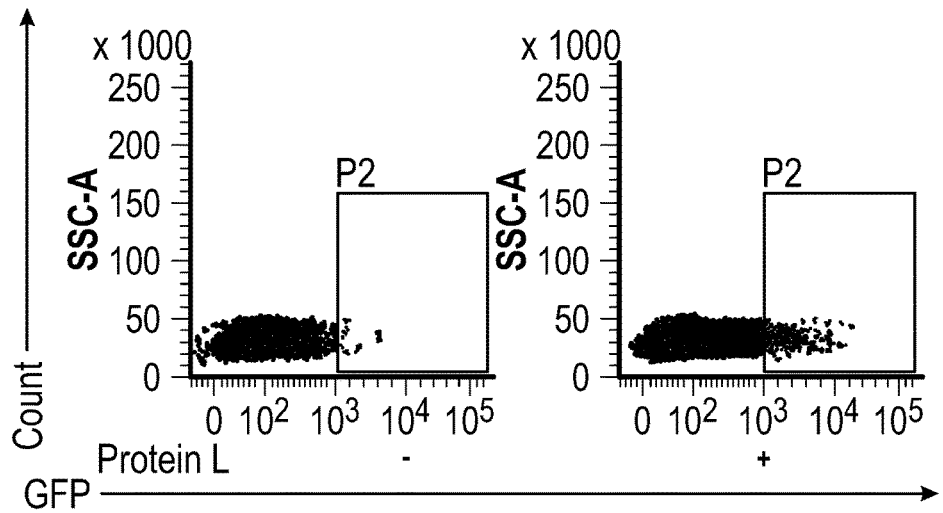

Use of Protein L microbeads and Protein L expressing cells for stimulation of SIR and CAR expressing cells. A number of Human cell-based artificial antigen-presenting cells for cancer immunotherapy have been described. One approach for ex vivo expansion of $CAR^+$ and $SIR^+$ T cells involves the use of irradiated artificial antigen presenting cells (aAPC) expressing the targeted tumor associated antigen (TAA). However, this approach requires that the aAPC be engineered to express each individual TAA. To overcome this problem, a universal antigen presenting cell was developed. Protein L is an immunoglobulin (Ig) light chain-binding protein expressed by some strains of the anaerobic bacterial species *Peptostreptococcus magnus*. Protein L binds to the framework region of the κ light chain vL domain and does not interfere with the antigen binding domain. As an alternative to expressing individual TAAs on aAPC, experiments were performed to determine if Protein L could activate $CAR^+$ T and $SIR^+$ T cells independent of specificity. In the initial experiments, coculture of Jurkat-NFAT-GFP cells expressing different CAR and SIR constructs were tested to determine whether Protein L magnetic beads would lead to induction of GFP expression. Pierce Protein L magnetic beads (cat. #88849; concentration 10 mg/ml) were purchased from ThermoFisher and diluted 1:10 in PBS. Approximately 10 µl of diluted beads were added per well in a U-bottom 96-well plate. Jurkat-NFAT-GFP parental cells or Jurkat-NFAT-GFP cells expressing the CD8SP-FMC63(vL-vH)-Myc-BBz-T2A-PAC (112014-A13) [SEQ ID NO:4501] CAR were added to the wells and cocultured with the beads for 18 hours. Induction of GFP expression was examined by Flow cytometry. FIG. 18 below shows modest induction of GFP expression by coculture of Jurkat-NFAT-GFP cells expressing CD8SP-FMC63(vL-vH)-Myc-BBz-T2A-PAC (112014-A13) [SEQ ID NO:4501] CAR with the Protein L beads.

Generation of human aAPC expressing Protein L on cell surface. Lentiviral chimeric antigen receptor (CAR) constructs were generated expressing different regions of Protein L in fusion with hinge and transmembrane regions of human CD8, 41BB costimulatory domain and CD3z chain. The nucleotide sequence of Protein L was codon optimized for optimal expression in human cells. It needs to be noted that the 41BB costimulatory domain and CD3z chain are not essential for the function of Protein L for the purpose of this invention. The vectors also carried N-terminal signal peptides derived from either human CD8 or IgH to allow cell surface transport of Protein L. The complete nucleic acid and amino acid sequence of the vectors are provided in SEQ ID NO: 888 and SEQ ID NO: 889.

The different Protein L constructs were transiently transfected into 293FT cells. The ability of cell surface expressed Protein L to bind to different scFV fragments was examined by incubating the cells with scFv-GGSG-NLuc fusion protein supernatants. 293FT cells expressing the different Protein L regions showed increased binding to scFV-GGSG-NLuc supernatants, thereby demonstrating that Protein L can be successfully expressed as cell surface protein in mammalian cells.

Next, 293 cells were infected with a lentivirus vector encoding the Protein L-II construct (072716-K01) and polyclonal population of cells stably expressing Protein L were generated following selection with 750 ng/ml puromycin. These 293-Protein L-II cells were used as antigen presenting cells and tested for their ability to activate Jurkat-NFAT-GFP cells expressing different SIR and CAR constructs. For this purpose, 293-Protein L-II cells were plated in 24 well plates and after 12-24 hr overlaid with Jurkat-NFAT-GFP cells expressing different SIR and CAR constructs, after co-culture for approximately 18 hours, induction of GFP expression was examined by Flow Cytometry. As shown in FIG. 19A-D, co-culture with 293-Protein L-II cells led to strong induction of GFP expression in Jurkat-NFAT-GFP cells expressing the CD8SP-FMC63(vL-vH)-Myc-BBz-T2A-PAC (112014-A13) [SEQ ID NO:4501] CAR, and CD8SP-HuLuc64-vL-V5-[hTCRb-KACIAH]-F-P2A-SP-HuLuc64-vH-Myc-[hTCRa-CSDVP]-F-F2A-PAC (092916-E07) [SEQ ID NO:1253], CD8SP-V5-[hTCRb-KACIAH]-F-P2A-CD8SP-CD19Bu12-vL-Gly-Ser-Linker-CD19Bu12-vH-Myc-[hTCRa-CSDVP]-F-F2A-PAC (082815-E05) [SEQ ID NO:1622] SIR constructs. These results demonstrate that mammalian cells expressing Protein L on their surface can serve as universal antigen presenting cells for stimulation of SIR and CAR expressing immune effector cells. The use of Protein-L expressing aAPC is, however, not limited to above type of cells. These cells can serve as universal aAPC for any immune effector cell which carries an antigen binding domain derived from a suitable κ chain containing antibody that can bind to Protein L.

Expression of SIR in Pgp positive Lymphocytes. Peripheral blood mononuclear cells (10 million cells) are obtained using Ficoll-Hypaque separation. Cells are centrifuged and cell pellets are blocked with 200 µl of human AB serum for 1 hr at 4° C. Cells are washed with ice cold PBS containing 1% FCS, and stained for 1 hr at 4° C. with three monoclonal antibodies UIC2 (200 µg/ml; Santa Cruz Biotechnology; SC-73354), MRK16, and 4E3 directed against P-glycoprotein (Pgp). Each antibody is used at a concentration of 0.5 µg/million cells) to increase the sensitivity of the assay. Following extensive washings with PBS containing 1% FCS, cells are stained with 5 µl (2.5 µg) of FITC-conjugated Goat F(ab)2 anti-mouse IgG (H+L) human adsorbed antibody (Southern Biotechnology; Cat #1032-02). After 2 washes, cells are labeled with PE-conjugated human CD3 antibody for 1 h at 4° C. Cells are washed and are analyzed by Flow cytometry The CD3 positive T lymphocytes are sorted into $Pgp^{+ve}$ and $Pgp^{-ve}$ fractions. Cells in each fraction are infected with lentivirus vector encoding the CD8SP-FMC63-vL-V5-[hTCRb-KACIAH]-F-P2A-SP-FMC63-vH-Myc-[hTCRa-CSDVP]-F-F2A-PAC (081415-D06) [SEQ ID NO:992] SIR or the negative control SIR CD8SP-KSHV-4C3-vL-V5-[hTCRb-S57C-opt]-F-P2A-SP-4C3-vH-Myc-[hTCRa-T48C-opt]-F-F2A-PAC (111815-O05) [SEQ ID NO: 4639]. NSG mice (Jackson Lab) are sub-lethally irradiated at a dose of 175 cGy. Approximately 24 hours post irradiation (day 2), mice are injected with $2.5 \times 10^4$ RAJI cells via tail-vein. On day 3, the mice (n=6 for each group) are treated with 5 million lymphocytes that had been infected with the indicated SIR encoding lentiviruses. Control mice (n=6) received no T cells or uninfected T cells. Mice are given human IL2 on alternate days. Mice given $Pgp^{+ve}$ T cells infected with the CD8SP-FMC63-vL-V5-[hTCRb-KACIAH]-F-P2A-SP-FMC63-vH-Myc-[hTCRa-CSDVP]-F-F2A-PAC (081415-D06) [SEQ ID NO:992] SIR survive longer as compared to the mice given $Pgp^{-ve}$ T cells infected with the CD8SP-FMC63-vL-V5-[hTCRb-KACIAH]-F-P2A-SP-FMC63-vH-Myc-[hTCRa-CSDVP]-F-F2A-PAC (081415-D06) [SEQ ID NO:992] SIR or $Pgp^{+ve}$ or $Pgp^{-ve}$ T cells infected with the negative control SIR CD8SP-KSHV-4C3-vL-V5-[hTCRb-S57C-opt]-F-P2A-SP-4C3-vH-Myc-[hTCRa-T48C-opt]-F-F2A-PAC (111815-O05) [SEQ ID NO: 4639]. The longer survival of mice given $Pgp^{+ve}$ T cells infected with the CD8SP-FMC63-vL-V5-[hTCRb-KACIAH]-F-P2A-SP-FMC63-vH-Myc-[hTCRa-CSDVP]-F-F2A-PAC (081415-D06) [SEQ ID NO:992] SIR correlates with longer in vivo persistence of SIR-T cells. The above experiment is repeated by enriching for Pgp-expressing T lymphocytes using other methods as described in International Application No. PCT/US2017/042248 (the disclosure of which is incorporated herein by reference) including MACS (Magnetic activated Cell sorting) and by exposure to TH9402 followed by exposure to light. Again, the mice given $Pgp^{+ve}$ T cells infected with the CD8SP-FMC63-vL-V5-[hTCRb-KACIAH]-F-P2A-SP-FMC63-vH-Myc-[hTCRa-CSDVP]-F-F2A-PAC (081415-D06) [SEQ ID NO:992] SIR survive longer, which correlates with longer in vivo persistence of SIR-T cells.

Use of Dasatinib to block the activity of SIR-T cells. T cells expressing the SIRs CD8SP-CD19Bu12-vL-V5-[TCRb-S57C-opt1]-F-P2A-SP-CD19Bu12-vH-Myc-[TCRa-T48C-opt1]-F-F2A-PAC (070215-M03) [SEQ ID NO:1021] and CD8SP-CD20-2F2-vL-V5-[hTCRb-KACIAH]-F-P2A-SP-CD20-2F2-vH-Myc-[hTCRa-CSDVP]-F-F2A-PAC (100615-D05) [SEQ ID NO:1221] are pre-incubated with the 100 nM of Dasatinib for approximately 30 min at 37° C. or left untreated. The drug-treated and untreated T cells are plated in a white 384-cell plate. RAJI cells stably expressing GLuc are added to the wells containing the T cells at a concentration of 30K cells/well to give an E:T ratio of 5:1. Dasatinib is also added to the wells to maintain the final concentrations at 100 nM. After 4-24 h of co-culture, SIR-T cells mediated induction of lysis of target cells is assayed by increase of GLuc activity by directly injecting 0.5×CTZ assay buffer containing native coeloentrazine. Results show significant inhibition of SIRs-induced cell death by 100 nM Dasatinib. Treatment with Dasatinib is found to significantly inhibit IFNγ and TNFα production following co-culture of SIR-T cells with the target cell line. The results demonstrate the ability of Dasatinib to block the cytotoxicity and cytokine production by SIR T cells. As Dasatinib is an FDA approved drug and can cross the blood brain barrier, it could be used to control the toxicity induced by SIR-T cells, including neurotoxicity, and to control the activity of SIR-T cells following their administration to the patients.

Use of PI3K inhibitors to expand SIR-T cells. Human peripheral blood T cells isolated using CD3 magnetic beads are infected with lentiviruses expressing the indicated SIR constructs targeting CD19. Cells are left unselected or selected with puromycin and expanded using the standard protocol described previously using CD3/CD28 beads and IL2 but in the absence or presence of dual PI3K/mTOR inhibitor PF-04691502 (0.10 µM to 0.5 µM). NSG mice (Jackson Lab) are sub-lethally irradiated at a dose of 175 cGy. 24 hours post irradiation (day 2), mice are injected with $2.5 \times 10^4$ RAJI cells via tail-vein. On day 3, the mice (n=5 for each group) are treated with 5 million T cells that had been infected with the indicated SIR encoding lentiviruses and expanded in the absence or presence of PF-04691502. Control mice (n=5) are injected with 5 million uninfected T cells. Mice are given human IL2 (400 IU i.p.) on alternate days till the death of all mice in control group. The median survival of mice which received (050515-L05) [SEQ ID NO:900]-SIR-T expanded in the presence of PI3K/AKT inhibitor is higher than the mice which received SIR-T cells that had been expanded in the absence of PI3K/AKT inhibitors.

Use of universal SIR-T cells expressing CD16 as the antigen binding domain. Daudi cells expressing luciferase are injected intraperitoneally (i.p.; $0.3 \times 10^6$ cells/mouse) in NSG mice (Jackson Laboratory). Some mice receive rituximab (150 mg) i.p. Human T cells ($1 \times 10^7$) expressing CD8SP-MYC-[hTCRa-T48C-opt1]-F-F2A-SP-CD16A-V158-ECD-v2-V5-[hTCRb-S57C-opt1]-F-P2A-PAC (SEQ ID NO: 2069) SIR are injected four days after Daudi inoculation. Control mice receive tissue culture medium instead of rituximab or T cells. Rituximab injection is repeated weekly for 4 weeks, with no further T lymphocyte injection. All mice receive intraperitoneal injections of 1,000-2,000 IU of IL-2 twice a week for 4 weeks. Mice receiving rituximab plus SIR-T cells show reduced tumor growth.

Use of in vitro and vivo selection to select SIRs with desired properties. A pool of SIRs targeting CD19 listed in Tables 7A-7H are targeted to the TRAC locus in T cells using TRAC gRNA (SEQ ID NO: 896) and techniques known in the art. The targeting vector also carry DNA barcodes located downstream of the stop codon of the SIR inserts. T cells can be derived from peripheral blood. In an alternate embodiment, T cells are derived from a single clone of iPSC or hematopoietic stem cells using techniques known in the art. T cells expressing the pool of SIRs are co-cultured with RAJI cells in vitro for 1 to 21 days. Aliquots of the SIR-T cell pools are collected before the culture with the target cells and on different days after co-culture. Samples are subjected to next generation sequencing to determine the relative frequency of different SIRs following exposure to the target cells. Bioinformatics analyses is used to determine the SIRs that are associated with better proliferative response following co-culture with the target cells. Essentially a similar approach is used to determine the SIRs that confer higher proliferative potential on T cells in vivo and/or persist long term in vivo and/or are present at higher frequency when normalized for their frequency in the starting T cell population in surviving animals as compared to animals that succumb to tumor challenge. In alternate embodiment of the disclosure, essentially a similar approach is used on human clinical samples to identify SIRs that are associated with different properties and/or outcomes including but not limited to better long term survival, lower incidence of cytokine release syndrome, lower neurotoxicity and/or higher long term persistence. Such SIRs can be subsequently used, either singly or in various combinations, to develop different SIR subpools, containing SIRs targeting the same or different antigen binding domains, with diverse properties for the treatment of different disease conditions and different patients. In other enablements, the SIR-T cells are exposed to their target cell line and then sorted into different sets based on the degree of intracellular IFNγ as determined by flow cytometry. The frequency of different SIRs in the low vs high IFNγ population is determined by next generation sequencing and normalized to their frequency in the control SIR-T cell population, i.e., SIR-T cells that have not been exposed to the target cell line or are exposed to a cell line that does not express the target of SIRs. From this analysis, SIRs that are associated with different levels of IFNγ production can be determined. A similar approach is used to screen for and select SIRs with any or a combination of desired properties or attributes including but not limited to, lower TNFα production, lower expression of exhaustion markers, lower expression of markers of terminal differentiation and/or higher expression of markers of cytotoxicity.

Use of IL7 along with SIR-T cells. The study is conducted as described in the preceding example with the exception that starting 1 day after the infusion of SIR-T cells, mice are administered exogenous recombinant human IL-7 at a dosage of 200 ng/mouse by intraperitoneal injection three times, while the control mice receive normal saline. The mice that receive IL-7 are shown to reject their tumor and survive longer than the control mice.

Use of shRNA targeting BRD4 along with SIR-T cells. The study is conducted as described in the preceding example with the exception that T cells expressing the SIR constructs represented by SEQ ID NO: 893 (pLenti-EF1α-CD8SP-FMC63-vL-V5-[hTCRb-KACIAH]-F-P2A-SP-FMC63-vH-Myc-[preTCRa-Del48]-F-F2A-PAC-shRNA-BRD4-DWPRE) which coexpresses an H1 promoter driven shRNA against BRD4 is used. This construct is compared against construct expressing a SIR represented by SEQ ID NO: 1200 which lacks shRNA targeting BRD4. The mice that receive shRNA construct coexpressing BRD4-shRNA (i.e. SEQ ID NO: 893) show longer persistence of SIR-T cells and survive longer.

The experiment is repeated with mice receiving T cells expressing SIR represented by SEQ ID NO: 1200 the exception that half the mice (n=6) receive twice daily intra-peritoneal injections of BRD4 inhibitor JQ1(+) (50 mg/kg), while the control mice receive vehicle control (10% β-cyclodextrin, Sigma). The mice that receive JQ1(+) show longer persistence of SIR-T cells and survive longer as compared to control mice.

Use of autologous SIR-T cells for adoptive cell therapy. SIR-T cells of the disclosure can be used for adoptive cell therapy. As an example, patients with relapsed Acute Lymphocytic Leukemia (ALL), Chronic Lymphocytic Leukemia (CLL), or high-risk intermediate grade B-cell lymphomas may receive immunotherapy with adoptively transferred autologous SIR-T cells targeting CD19. A leukapheresis product collected from each patient undergoes selection of CD3-positive T lymphocytes using the CliniMACS Prodigy® System from Miltenyi Biotec and following the manufacturer's recommendations. The T lymphocytes are optionally enriched for Pgp-positive T cells using Flow sorting following staining with Pgp antibodies, MACS following staining with Pgp antibodies or Photodynamic selection following exposure to TH9402 plus light. Cells are transduced with clinical grade CD19-SIR virus (e.g., CD8SP-CD19Bu12-vL-V5-[hTCRb-KACIAH]-F-P2A-CD19Bu12-vH-My c-[hTCRa-CSDVP]-F-F2A-GMCSF-SP-tEGFR( ) [SEQ ID NO:1087] and then selection and expansion of the SIR-T cells occur in a closed system. After the resulting cell products have undergone quality control testing (including sterility and tumor specific cytotoxicity tests), they are cryopreserved. Meanwhile, following leukapheresis, study participants commence with lymphodepletive chemotherapy (30 mg/m$^2$/day fludarabine plus 500 mg/m$^2$/day cyclophosphamide×3 days). One day after completion of their lymphodepleting regimen, the previously stored SIR-T cell product is transported, thawed and infused at the patient's bedside. The study participant receives SIR-transduced lymphocytes infused intravenously followed by high-dose (720,000 IU/kg) IL-2 (Aldesleukin; Prometheus, San Diego, CA) every 8 hours to tolerance. The dose of SIR-T product varies from $1\times10^4$ SIR+ve CD3 cells/kg to $5\times10^9$ SIR+ve CD3 cells/kg as per the study protocol. The SIR-T product may be administered in a single infusion or split infusions. Research participants can be pre-medicated at least 30 minutes prior to T cell infusion with 15 mg/kg of acetaminophen P.O. (max. 650 mg) and diphenhydramine 0.5-1 mg/kg I.V. (max dose 50 mg). The study participant may optionally receive daily injections of human IL-2. Clinical and laboratory correlative follow-up studies can then be performed at the physician's discretion, and may include quantitative RT-PCR studies for the presence of CD19-expressing ALL/lymphoma cells and/or the adoptively transferred T cells; FDG-PET and/or CT scans; bone marrow examination for disease specific pathologic evaluation; lymph node biopsy; and/or long-term follow up per the guidelines set forth by the FDA's Biologic Response Modifiers Advisory Committee that apply to gene transfer studies. Essentially a similar approach can be used to treat other diseases using autologous immune cells (e.g., T cells) that have been engineered to express the SIR of the disclosure where the SIR targets an antigen or antigens expressed on the disease causing or disease-associated cells.

Use of autologous SIR-T cells targeting multiple antigens for adoptive cell therapy. Patients many different diseases, including infectious diseases (e.g., HIV1, EBV, CMV, HTLV1, etc), degenerative diseases (e.g., Alzheimer's disease), autoimmune disease (e.g., pemphigous vulgaris), allergic diseases (e.g., chronic idiopathic urticarial) and multiple cancers are enrolled in an IRB approved phase I clinical trial of to immunotherapy with adoptively transferred autologous SIR-T cells targeting different disease causing or disease associated antigens. The SIR for different diseases are selected based on the known expression of their target antigen in the disease causing or disease associated cells. Where possible, the expression of the SIR target on the disease causing or disease associated cells is confirmed by binding with ABD-GGS-NLuc fusion protein in which the antigen binding domain of SIR fused to non-secretory form of NLuc protein via a flexible linker. Alternatively, immunohistochemistry or flow cytometry using commercially available antibodies is used to confirm the expression of the SIR target on disease causing or disease associated cells. T cells are collected from the subject using leukopheresis, transduced with the appropriate SIR encoding lentivirus vector and expanded ex vivo using CD3/CD28 beads in a closed system. After the resulting cell products have undergone quality control testing (including sterility and tumor specific cytotoxicity tests), they are cryopreserved. Meanwhile, study participants commence with lymphodepletive chemotherapy (30 mg/m$^2$/day fludarabine plus 500 mg/m$^2$/day cyclophosphamide×3 days). One day after completion of their lymphodepleting regimen, the study participant receives transduced lymphocytes infused intravenously followed by high-dose (720,000 IU/kg) IL-2 (Aldesleukin; Prometheus, San Diego, CA) every 8 hours to tolerance. The previously stored SIR-T cell product is transported, thawed and infused at the patient's bedside. The dose of SIR-T product varies from 1×10$^4$ SIR+ve CD3 cells/kg to 5×10$^9$ SIR+ve CD3 cells/kg as per the study protocol. The SIR-T product may be administered in a single infusion or split infusions. Research participants can be pre-medicated at least 30 minutes prior to T cell infusion with 15 mg/kg of acetaminophen P.O. (max. 650 mg) and diphenhydramine 0.5-1 mg/kg I.V. (max dose 50 mg). The study participant may optionally receive daily injections of human IL-2. Clinical and laboratory correlative follow-up studies can then be performed at the physician's discretion.

Use of an mTOR inhibitor RAD001 in combination with SIR-T cells. The study is conducted as described in the preceding examples with the exception that starting 1 day after the infusion of SIR-T cells, study participants are administered an mTOR inhibitor, e.g., an allosteric inhibitor, e.g., RAD001, at a dosage that provides a target trough level 0.1 to 3 ng/ml, where the trough level" refers to the concentration of a drug in plasma just before the next dose, or the minimum drug concentration between two doses.

Use of Ibrutinib in combination with SIR-T cells. The study is conducted as described in the preceding examples with the exception that starting 1 day after the infusion of SIR-T cells, study participants are administered oral ibrutinib at dose of 140 mg/d to 420 mg/d. It is noted that the study participant receiving ibrutinib has less incidence of severe cytokine release syndrome as compared to participants who received SIR-T cells without ibrutinib.

Use of allogeneic SIR-T cells for adoptive cells therapy. Patients with relapsed Acute Lymphocytic Leukemia or high-risk intermediate grade B-cell lymphomas who have undergone an allogeneic bone marrow transplant may receive immunotherapy with adoptively transferred allogeneic SIR-T cells. A leukapheresis product collected from the donor (same donor as used for the allogeneic transplant) undergoes selection of CD3 positive T lymphocytes using the CliniMACS Prodigy® System from Miltenyi Biotec and following the manufacturer's recommendations. The T lymphocytes are optionally enriched for Pgp-positive T cells using Flow sorting following staining with Pgp antibodies, MACS following staining with Pgp antibodies or Photodynamic selection following exposure to TH9402 plus light. Cells are activate using a CD3 and CD28 magnetic bead-based artificial antigen presenting cells and transduced with clinical grade CD19-SIR virus (e.g., CD8SP-CD19Bu12-vL-V5-[hTCRb-KACIAH]-F-P2A-CD19Bu12-vH-Myc-[hTCRa-CSDVP]-F-F2A-icasapase9[SEQ ID NO:1080]. Cells are expanded for 9-12 days in a closed system. After the resulting cell products have undergone quality control testing (including sterility and tumor specific cytotoxicity tests), they are cryopreserved. Meanwhile, study participants commence with lymphodepletive chemotherapy (30 mg/m$^2$/day fludarabine plus 500 mg/m$^2$/day cyclophosphamide×3 days). One day after completion of their lymphodepleting regimen, the study participant receives transduced lymphocytes infused intravenously followed by high-dose (720,000 IU/kg) IL-2 (Aldesleukin; Prometheus, San Diego, CA) every 8 hours to tolerance. The SIR-T cell product is transported, thawed and infused at the patient's bedside. The dose of SIR-T product may vary from 1×10$^4$ SIR+ve CD3 cells/kg to 5×10$^9$ SIR+ve CD3 cells/kg as per the study protocol. The SIR product may be administered in a single infusion or split infusions. Research participants can be pre-medicated at least 30 minutes prior to SIR-T cell infusion with 15 mg/kg of acetaminophen P.O. (max. 650 mg) and diphenhydramine 0.5-1 mg/kg I.V. (max dose 50 mg). Clinical and laboratory correlative follow-up studies can then be performed at the physician's discretion, and may include quantitative RT-PCR studies for the presence of CD19-expressing ALL/lymphoma cells and/or the adoptively transferred T cells; FDG-PET and/or CT scans; bone marrow examination for disease specific pathologic evaluation; lymph node biopsy; and/or long-term follow up per the guidelines set forth by the FDA's Biologic Response Modifiers Advisory Committee that apply to gene transfer studies. Use of immunosuppressive drugs is also at the discretion of the physician. Essentially a similar approach can be used to treat other diseases using allogeneic immune cells (e.g., T cells) expressing the SIR of the disclosure where the SIR targets an antigen or antigens expressed on the disease causing or disease-associated cells.

SIR-T Cell Hepatic Arterial Infusion. In addition to intravenous infusion, SIR-T cells can be infused intra-arterially to provide high concentration of SIR-T cells in a local area or organ involved with a disease. In the following example, this approach is used in case of a patient with hepatic metastases from a gastrointestinal cancer which expresses Folate Receptor alpha (FR1). Essentially a similar approach can be used for intra-arterial infusion of SIR-T cells targeting other tumor antigens.

A mapping angiogram is performed via a right common femoral artery approach at baseline. The gastroduodenal and right gastric arteries, in addition to other potential sources of extrahepatic perfusion, is embolized with microcoils. The same arterial access procedure is carried out for administration of T cells expressing the CD8SP-FR1-huMov19-vL-V5-[hTCRb-KACIAH]-F-P2A-SP-FR1-huMov19-vH-Myc-[hTCRa-CSDVP]-F-F2A-PAC (102915-P07) [SEQ ID NO:1276] SIR. The T cells is collected from the patient on day 0 and are infected with SIR encoding lentivirus and expanded as described in the previous examples. The SIR-T cells will be given in a dose escalating fashion on day 14 (10$^8$ SIR-T cells), day 28 (10$^9$ SIR-T cells) and day 44 (10$^{10}$ SIR-T cells). The SIR-T cells are injected manually via a 60 cc syringe at a rate of <2 cc/second. The total volume of infusion is approximately 100 cc. Angiography with calibrated contrast rate is performed after the first infusion of 50 cc and at completion of the SIR-T infusion to confirm preserved arterial flow. Infusions are delivered into the proper hepatic artery when possible. Certain patients have aberrant hepatic arterial anatomy, where either the right or left hepatic artery does not arise from the proper hepatic artery. In such cases the dose of SIR-T cells is split based upon lobar volume calculations. In such cases, split doses are delivered separately into the right and left hepatic arteries to ensure proportionate SIR-T delivery to both hepatic lobes.

Clinical assessments are performed at baseline, on infusion days, and 1, 2, 4, and 7 days post-infusion. Planned imaging assessments with liver MRI and PET examinations are scheduled within one month prior to the first infusion and then within one month following the last SIR-T infusion. The study radiologist (BS) grades responses according to modified RECIST (mRECIST) and immune related response criteria (Wolchok et al., 2009, Clin Cancer Res, 15:7412-7420). Percutaneous biopsies are performed prior to treatment and three weeks following the final dose. A blinded pathologist scores tumor necrosis and fibrosis on the biopsy specimens. Safety evaluation is performed per protocol. National Cancer Institute Common Terminology Criteria for Adverse Events version 3.0 is used to grade the severity of adverse events.

Intraperitoneal administration of SIR-T cells. SIR-T cells can also be administered intraperitoneally, essentially as described in Koneru M et al (Journal of Translational Medicine; 2015; 13:102). In the following example, this approach is used in case patients with peritoneal involvement with ovarian cancer which expresses Folate Receptor alpha (FR1). Essentially a similar approach can be used for intra-peritoneal infusion of SIR-T cells targeting other tumor antigens.

A screening informed consent will be offered to patients with recurrent high-grade serous ovarian cancer to test their cancer for the expression of FR1. In case the expression of FR1 is confirmed by immunohistochemistry, then patients will have a leukapheresis product obtained from peripheral blood. Excess platelet and red blood cell contamination is removed from the leukapheresis product and the product frozen. In the treatment phase of the study, the leukapheresis product will be thawed and washed. Subsequently, CD3+ T cells will be isolated from the thawed leukapheresis product by magnetic separation using CD3/CD28 beads. Activated T cells will be lentivirally transduced with the CD8SP-FR1-huMov19-vL-V5-[hTCRb-KACIAH]-F-P2A-SP-FR1-huMov19-vH-Myc-[hTCRa-CSDVP]-F-F2A-PAC (102915-P07) [SEQ ID NO:1276] SIR and further expanded using CD3/CD28 bead expansion protocol.

This is a phase I clinical trial testing the safety of intravenous (IV) and intraperitoneal (IP) infusion (with or without prior cyclophosphamide chemotherapy) of genetically modified autologous T cells in patients with recurrent FR1+ ovarian, fallopian tube, or primary peritoneal cancer. These autologous T cells will be genetically engineered to express the CD8SP-FR1-huMov19-vL-V5-[hTCRb-KACIAH]-F-P2A-SP-FR1-huMov19-vH-Myc-[hTCRa-CSDVP]-F-F2A-PAC (102915-P07) [SEQ ID NO:1276] SIR. Patients with recurrent high-grade serous ovarian, primary peritoneal or fallopian tube carcinoma shown to express FR1 antigen confirmed by immunohistochemistry (IHC) analysis of banked (paraffin embedded) or freshly biopsied tumor will potentially be eligible for the study. Only moderate to strong immunoreactive scores (3-5) will be considered positive, with a score of 3 described as 51-75% strong or 51-100% weak, 4 as 76-99% strong, and 5 as 100% strong staining. All patients will have received prior chemotherapy for recurrence, with a maximum of five prior lines of chemotherapy permitted. Patients with other active malignancies, a life expectancy of <3 months, or a Karnofsky Performance Status (KPS) score<70% at the time of planned treatment will be ineligible.

The phase I dose-escalation desing will be used in the trial. Cohorts of 3-6 patients will be infused with escalating doses of modified T cells to establish the maximum tolerated dose (MTD). There are four planned dose levels: $3\times10^5$, $1\times10^6$, $3\times10^6$, and $1\times10^7$ CD8SP-FR1-huMov19-vL-V5-[hTCRb-KACIAH]-F-P2A-SP-FR1-huMov19-vH-Myc-[hTCRa-CSDVP]-F-F2A-PAC (102915-P07) [SEQ ID NO:1276] SIR-T cells/kg. Cohorts I and II will be treated with $3\times10^5$ CD8SP-FR1-huMov19-vL-V5-[hTCRb-KACIAH]-F-P2A-SP-FR1-huMov19-vH-Myc-[hTCRa-CSDVP]-F-F2A-PAC (102915-P07) [SEQ ID NO:1276] SIR-T cells/kg but patients in cohort II will also receive lymphodepleting cyclophosphamide. Cohorts II-V will receive escalating doses of the modified T cells following pretreatment with cyclophosphamide. Lymphodepleting cyclophosphamide dosed at 750 mg/m2 will be administered 2-4 days prior to the initial T cell infusion. A standard 3+3 dose escalation schema will be followed. If the first dose level exceeds the MTD, a subsequent cohort of 3-6 patients will be treated at the −1 dose level of $1\times10^5$ CD8SP-FR1-huMov19-vL-V5-[hTCRb-KACIAH]-F-P2A-SP-FR1-huMov19-vH-Myc-[hTCRa-CSDVP]-F-F2A-PAC (102915-P07) [SEQ ID NO:1276] SIR-T cells/kg without the addition of lymphodepleting cyclophosphamide (cohort-I).

An IP catheter will be placed prior to T cell infusion. The catheter will be placed when the modified T cells are ready for administration. Patients will be admitted to the inpatient unit of the hospital prior to their first infusion of SIR T cells and will remain hospitalized until at least 3 days after the second infusion of SIR T cells. The first cohort of patients to be treated, and the first patient treated in each subsequent cohort, will be admitted to the intensive care unit (ICU); subsequent patients may be admitted to the medical oncology in-patient service (subject to the clinical judgment of the treating physician).

Patients will receive a single dose of lymphodepleting cyclophosphamide (750 mg/m2 IV) chemotherapy 2 to 4 days prior to initiating treatment with SIR-modified T cells. The transduced T cells will be quality tested for number, purity, viability, and sterility prior to infusion. The following T cell release criteria must be met, including viability >80%, CD3+≥95% and the infused T cell population must have a transduced fraction of >20% based on flow cytometric analysis of expanded T cell population. Furthermore, the average vector copy number in the transduced T cells will be determined by real time PCR before infusion and will need to be in the range of 0.3 to 5 copies per cell, and PCR will be used to ensure the absence of replication competent lentivirus in the transduced T cells. All patients will receive 50% of the genetically modified T cell dose intravenously. Patients will be closely monitored for toxicities. One to 3 days later, the remaining dose of T cells will be administered as an IP infusion. At least 3 patients will be treated at dose level 1, with an accrual of no more than 2 patients per month within each dose level. At least one week will elapse between treatments of each patient enrolled. All patients treated in the preceding cohort will be observed for a minimum of 4 weeks from the day of the initial T cell infusion before escalation to the next cohort occurs. In light of a significant risk for neutropenia (ANC ≤1,000/mm3) following cyclophosphamide therapy, patients treated with cyclophosphamide may be treated with growth factor support at the discretion of the investigators (either a single subcutaneous injection of pegfilgrastim or 3 consecutive days of subcutaneous filgrastim).

Blood samples will be obtained from all patients prior to and following treatment to assess toxicity, therapeutic effects, and survival of the genetically modified T cells. Post-treatment blood samples will be collected at approximately 1 hr, 1 day, and at 1, 2, 3, 4, 5, 6, 7, 8 and 12 weeks post T cell infusion, then monthly thereafter until 1 year, then yearly thereafter up to 15 years post T-cell infusions. If technically feasible, patients' ascitic fluid may also be sampled prior to cyclophosphamide or T cell therapy (whichever comes first), as well as during follow-up. Patients will have CT scans at approximately 6 weeks, 3 months, 6 months, 9 months and 12 months after T cell infusion, and thereafter if clinically indicated.

Use of SIR-T cells for intratumoral injection. SIR-T cells can also be administered intra-tumorally, essentially as described in Brown C E, et al, Clin Cancer Res. 2015 Sep. 15; 21(18): 4062-4072. In the following example, this approach is used in case of patients with recurrent glioblastoma (GBM) which expresses IL13Ra2. Essentially a similar approach can be used for intra-tumoral injection of SIR-T cells targeting other tumor antigens.

A pilot safety and feasibility study will be conducted to test CD8SP-IL13Ra2-hu107-vL-V5-[hTCRb-KACIAH]-F-P2A-SP-IL13Ra2-hu107vH-Myc-[hTCRa-CSDVP]-F-F2A-PAC (051816-Y03) [SEQ ID NO:1306] SIR expressing T cells in recurrent GBM. All participating patients will be required to give written informed consent. The clinical protocol will be approved by the University of Southern California Institutional Review Board and conducted under an Investigational New Drug Application, and registered at ClinicalTrials.gov. Eligible patients will include adults (18-70 yrs) with recurrent or refractory unifocal supratentorial grade III or IV glioma whose tumors do not show communication with ventricles/CSF pathways and are amenable to resection. Participation in this trial will be independent of IL13Rα2 (or IL13Ra2) tumor antigen status. Patients will be enrolled following initial diagnosis of high-grade glioma (WHO grade III or IV), at which time they will undergo leukapheresis for collection of peripheral blood mononuclear cells (PBMC). These cells will be used to engineer T cells to express the CD8SP-IL13Ra2-hu107-vL-V5-[hTCRb-KACIAH]-F-P2A-SP-IL13Ra2-hu107vH-Myc-[hTCRa-CSDVP]-F-F2A-PAC (051816-Y03) [SEQ ID NO:1306] SIR containing the puromycin resistance gene (PAC) following infection with the corresponding lentiviral vector as described in the previous examples. Alternatively, the SIR-T cells could be generated following infection with a retroviral vector or using sleeping beauty transposon or by transfection of IVT mRNA. Subsequently, the release tested therapeutic SIR-T cells will be cryopreserved and stored for later use. At the time of first recurrence of the tumor, the research participant will undergo resection of tumor along with placement of a Rickham reservoir/catheter. Concurrently, the therapeutic SIR-T cells will be thawed, re-expanded in vitro using CD3/CD28 beads based rapid expansion protocol. Following recovery from surgery and post baseline MR imaging, the CD8SP-IL13Ra2-hu107-vL-V5-[hTCRb-KACIAH]-F-P2A-SP-IL13Ra2-hu107vH-Myc-[hTCRa-CSDVP]-F-F2A-PAC (051816-Y03) [SEQ ID NO:1306] SIR will be administered directly into the resection cavity via the indwelling catheter, essentially as described (Brown C E, et al, Clin Cancer Res. 2015 Sep. 15; 21(18): 4062-4072). Cells will be manually injected into the Rickham reservoir using a 21 gauge butterfly needle to deliver a 2 mL volume over 5-10 minutes, followed by 2 mL flush with preservative free normal saline over 5 minutes. The protocol treatment plan will specify an intra-patient dose escalation schedule with a target of 12 CAR T cell doses administered intracranially over a 5 week period comprised of weekly treatment cycles. During cycles 1, 2, 4 and 5, T cell infusions will be performed on days 1, 3 and 5 of the cycle week, and week 3 will be a rest cycle. For safety, in cycle 1 we will utilize an intrapatient dose escalation strategy, with SIR T cell doses of $10^7$, $5 \times 10^7$ and $10^8$ cells per infusion administered on days 1, 3 and 5 respectively, and this will be followed by 9 additional SIR T cell infusions of $10^8$ cells over 4 weeks. Imaging to assess response will be performed during the week 3 rest cycle and after week 5. The guidelines provided in the NCI Common Toxicity Criteria version 2.0 (https://ctep.ifo.nih.gov/l) will be followed for the monitoring of toxicity and adverse event reporting Use of SIR-T cells for ex-vivo purging of bone marrow or peripheral blood stem cell preparation prior to transplant. SIR T cells can be used to purge the bone marrow or peripheral blood stem cell preparation of cancer cells prior to stem cell transplant. In the following example, CD8SP-HuLuc64-vL-V5-[hTCRb-KACIAH]-F-P2A-SP-HuLuc64-vH-Myc-[hTCRa-CSDVP]-F-F2A-PAC (092916-E07) [SEQ ID NO:1253] expressing SIR-T cells are used to purge bone marrow or peripheral blood stem cells obtained from a patient with multiple myeloma prior to autologous stem cell (or bone marrow) transplant.

Patient will undergo leukopheresis to collect peripheral blood mononuclear cells (PBMC). T cells will be purified using CD3 beads. These cells will be used to engineer T cells to express the CD8SP-HuLuc64-vL-V5-[hTCRb-KACIAH]-F-P2A-SP-HuLuc64-vH-Myc-[hTCRa-CSDVP]-F-F2A-PAC (092916-E07) [SEQ ID NO:1253] SIR containing the puromycin resistance gene (PAC) following infection with the corresponding lentiviral vector as described in the previous examples. This SIR targets CS1, an antigen expressed on myeloma cells. SIR-T expressing CD8SP-CS1-huLuc90-vL-V5-[hTCRb-KACIAH]-F-P2A-SP-huLuc90-vH-Myc-[hTCRa-CSDVP]-F-F2A-PAC (012716-A02) [SEQ ID NO:1254], CD8SP-CD138-vL-V5-[hTCRb-KACIAH]-F-P2A-SP-CD138-vH-Myc-[hTCRa-CSDVP]-F-F2A-PAC (100815-A05) [SEQ ID NO:1236] or CD8SP-GPRC5D-ET150-5-vL-Myc2-[hTCRb-KACIAH]-F-P2A-SP-GPRC5D-ET150-5-vH-Myc4-[hTCRa-CSDVP]-F-F2A-PAC (100616-C03) [SEQ ID NO:1285] will be used as alternatives or in combination with the above SIR-T cells targeting CS1. Alternatively, the SIR-T cells could be generated following infection with a retroviral vector or using sleeping beauty transposon or by transfection of IVT mRNA. Subsequently, the release tested therapeutic SIR-T cells will be cryopreserved and stored for later use or used fresh. Bone marrow cells and peripheral blood progenitor cell products will be collected from a patient with multiple myeloma following standard procedures. For mobilization of peripheral blood stem cells, patients will received cyclophosphamide, 3 μm/m2 followed by G-CSF, 10 μg/kg subcutaneously each day beginning 24 h after cyclophosphamide until pheresis was complete. Peripheral blood stem cells will be collected once the peripheral blood CD34+-cell count was 15 cells/μl. The collection goal will be to process three blood volumes per day until a minimum of 2.0 times $10^6$ CD34+ cells/kg are reached after processing. The bone marrow and peripheral blood stem cell products will be optionally depleted of Red Blood Cells and/or enriched for CD34 expressing cells using CliniMACS Prodigy® System from Miltenyi Biotec and following the manufacturer's recommendations. The products will be used for ex vivo purging fresh or cryopreserved. For purging, the bone marrow or peripheral blood stem cell products will be cocultured with thawed SIR-T cells at an effector to target ratio ranging from 5:1 to 30:1 for 4 to 24 hours in XVIVO medium (Lonza) supplanted with 100 IU recombinant human-IL2. Cells will be cultured at 37° C., in a 5% CO2 humidified incubator. At the end of the coculture period, an aliquot of the cells will be taken for sterility and quality testing (including measurement of CFU-GM and flow cytometry for CD34 and CD138 positive cells). The remaining sample will be administered intravenously to the patient who has previously received myeloablative chemotherapy (e.g., high dose Melphalan in two divided doses of 70 mg/m$^2$ for a total dose of 140 mg/m$^2$).

Use of auto-SIR for suppression of autoimmune diseases. Patients with pemphigous vulgaris will be enrolled in a clinical trial to test the safety and efficacy of SIR containing Dsg3 extracellular domain. Patients will be enrolled following diagnosis of pemphigous vulgaris that is resistant to treatment, at which time they will undergo leukapheresis for collection of peripheral blood mononuclear cells (PBMC). These cells will be used to engineer T cells to express the SIR CD8SP-MYC-[hTCRa-T48C-opt1]-F-F2A-SP-Dsg3-ECD-V5-[hTCRb-S57C-opt1]-F-P2A-PAC (SEQ ID NO: 1144) following infection with the corresponding lentiviral vector as described in the previous examples. Alternatively, the SIR-T cells will be generated following infection with a retroviral vector or using sleeping beauty transposon or by transfection of IVT mRNA. Subsequently, the release tested therapeutic SIR-T cells will be cryopreserved and stored for later use. Patients will receive a single dose of lymphodepleting cyclophosphamide (750 mg/m2 IV) chemotherapy 2 to 4 days prior to initiating treatment with SIR-modified T cells. The transduced T cells will be quality tested for number, purity, viability, and sterility prior to infusion. The dose of SIR-T product may vary from $1\times10^4$ SIR+ve CD3 cells/kg to $5\times10^9$ SIR+ve CD3 cells/kg as per the study protocol. The SIR product may be administered in a single infusion or split infusions. Research participants can be pre-medicated at least 30 minutes prior to SIR-T cell infusion with 15 mg/kg of acetaminophen P.O. (max. 650 mg) and diphenhydramine 0.5-1 mg/kg I.V. (max dose 50 mg). Clinical and laboratory correlative follow-up studies can then be performed at the physician's discretion.

A number of embodiments have been set forth above to illustrate the disclosure. The following claims further set forth what the Applicants regard as their invention.

SEQUENCE LISTING (19558 sequences)

SEQ ID NO: 1 - DNA, 63 bp, Artificial Sequence
  CD8_Signal_Peptide
atggccttaccagtgaccgccttgctcctgccgctggccttgctgctccacgccgccaggccg

SEQ ID NO: 2 - DNA, 63 bp, Artificial Sequence
  CD8_Signal_Peptide
atggccctgcccgtgacagccctgctgctgcctctggctctgctgctgcacgccgccagaccc

SEQ ID NO: 3 - DNA, 63 bp, Artificial Sequence
  CD8_Signal_Peptide
atggcccttccagtcactgccttgctgttgcctctggcgctcctgctccacgccgctagaccg

SEQ ID NO: 4 - DNA, 63 bp, Artificial Sequence
  CD8_Signal_Peptide
atggccctgcctgtgacagctctgctgctgcctctggcactgctgctgcacgccgccagacct

SEQ ID NO: 5 - DNA, 57 bp, Artificial Sequence
  IgH Signal Peptide
atggattggatatggaggatactttttctcgtgggggcagcaaccggggctcattcc

SEQ ID NO: 6 - DNA, 57 bp, Artificial Sequence
  IgH Signal Peptide
atggactggatttggcgcatccttttccttgtcggcgctgctaccggcgcgcattcc

SEQ ID NO: 7 - DNA, 57 bp, Artificial Sequence
  IgH Signal Peptide
atggactggatttggcgcatccttttccttgtcggcgctgctaccggcgcgcattct

SEQ ID NO: 8 - DNA, 57 bp, Artificial Sequence
  IgH Signal Peptide
atggactggatttggcgcatccttttccttgtcggcgctgctaccggcgcccattcc

SEQ ID NO: 9 - DNA, 60 bp, Artificial Sequence
  Signal Peptide
atgaggctccctgctcagctcctggggctgctaatgctctgggtctctggaagcagtggg

SEQ ID NO: 10 - DNA, 60 bp, Artificial Sequence
  hCD19 Signal Peptide
atgccacctcctcgcctcctcttcttcctcctcttcctcacccccatggaagtcaggccc

SEQ ID NO: 11-15 - skipped (5 entries)

SEQ ID NO: 16 - DNA, 333 bp, Artificial Sequence
  Light Chain Variable Fragment (vL)
gacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaag

SEQ ID NO: 17 - DNA, 321 bp, Artificial Sequence
  Light Chain Variable Fragment (vL)
gacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaac

SEQ ID NO: 18 - DNA, 336 bp, Artificial Sequence
  Light Chain Variable Fragment (vL)
gatgttgtgatgactcagtctccactctccctgcccgtcacccctggagcgccggcctccatctcctgcagatccagtcagagcattgtacatagtaatggaaacacctatttagagtggtatcttcaaaagccagggcagtctccaaagctcctgatctataaagtttccaaccgattttctggagtccctgacaggttcagtggaagtggatcaggcacagattttacactgagaatcagcagagtggaggctgaggatgttggaatttattactgctttcaaggttcacatgttcctccgacgttcggccctgggaccaaattggaaatcaaa

SEQ ID NO: 19 - DNA, 336 bp, Artificial Sequence
  Light Chain Variable Fragment (vL)
cagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggt

SEQ ID NO: 20 - DNA, 333 bp, Artificial Sequence
  Light Chain Variable Fragment (vL)
caggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggt

SEQ ID NO: 21 - DNA, 336 bp, Artificial Sequence
  Light Chain Variable Fragment (vL)
gacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagaga

SEQ ID NO: 22 - DNA, 324 bp, Artificial Sequence
  Light Chain Variable Fragment (vL)
gacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgt

SEQ ID NO: 23 - DNA, 336 bp, Artificial Sequence
  Light Chain Variable Fragment (vL)
gacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaag

SEQ ID NO: 24 - DNA, 342 bp, Artificial Sequence
  Light Chain Variable Fragment (vL)
gacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagaga

SEQ ID NO: 25 - DNA, 321 bp, Artificial Sequence
  Light Chain Variable Fragment (vL)
gacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaa

SEQ ID NO: 26 - DNA, 318 bp, Artificial Sequence
  Light Chain Variable Fragment (vL)
gacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaag

SEQ ID NO: 27 - DNA, 339 bp, Artificial Sequence
  Light Chain Variable Fragment (vL)
gacatcgtgatgacccaggccgctcccagcatccctgtgacacctggcgagagcgtgtccatctcctgccggtctagcaagagcctgctgaacagcaacggcaatacctacctgtactggttcctccagcggccaggccagtctccccaactgctgatctaccggatgagcaacctggcctccggcgtgcccgatagattttctggcagcggctccggcaccgccttcaccctgagaatcagcagagtggaagccgaggacgtgggcgtgtactactgtatgcagcacctggaataccccttcaccttcggagccggcaccaagctggaactgaagaga

SEQ ID NO: 28 - DNA, 321 bp, Artificial Sequence
  Light Chain Variable Fragment (vL)
gagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagaga

SEQ ID NO: 29 - DNA, 333 bp, Artificial Sequence
  Light Chain Variable Fragment (vL)
gacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaag

SEQ ID NO: 30 - DNA, 321 bp, Artificial Sequence
  Light Chain Variable Fragment (vL)
gacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcaca

SEQ ID NO: 31 - DNA, 321 bp, Artificial Sequence
  Light Chain Variable Fragment (vL)
gacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcaca

SEQ ID NO: 32 - DNA, 321 bp, Artificial Sequence
  Light Chain Variable Fragment (vL)
gacatccagatgacacagactacatcctcactgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcaca

SEQ ID NO: 33 - DNA, 321 bp, Artificial Sequence
  Light Chain Variable Fragment (vL)
gagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaag

SEQ ID NO: 34 - DNA, 321 bp, Artificial Sequence
  Light Chain Variable Fragment (vL)
gagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaa

SEQ ID NO: 35 - DNA, 339 bp, Artificial Sequence
  Light Chain Variable Fragment (vL)
gacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcgg

SEQ ID NO: 36 - DNA, 339 bp, Artificial Sequence
  Light Chain Variable Fragment (vL)
gacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcgg

SEQ ID NO: 37 - DNA, 324 bp, Artificial Sequence
  Light Chain Variable Fragment (vL)
gacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcgg

SEQ ID NO: 38 - DNA, 321 bp, Artificial Sequence
  Light Chain Variable Fragment (vL)
gacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaag

SEQ ID NO: 39 - DNA, 330 bp, Artificial Sequence
  Light Chain Variable Fragment (vL)
gagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagaga

SEQ ID NO: 40 - DNA, 336 bp, Artificial Sequence
  Light Chain Variable Fragment (vL)
gacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaag

SEQ ID NO: 41 - DNA, 336 bp, Artificial Sequence
  Light Chain Variable Fragment (vL)
gacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaag

SEQ ID NO: 42 - DNA, 321 bp, Artificial Sequence
  Light Chain Variable Fragment (vL)
gacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaag

SEQ ID NO: 43 - DNA, 336 bp, Artificial Sequence
  Light Chain Variable Fragment (vL)
gacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaag

SEQ ID NO: 44 - DNA, 318 bp, Artificial Sequence
  Light Chain Variable Fragment (vL)
cagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaag

SEQ ID NO: 45 - DNA, 339 bp, Artificial Sequence
  Light Chain Variable Fragment (vL)
gagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagaga

SEQ ID NO: 46 - DNA, 342 bp, Artificial Sequence
  Light Chain Variable Fragment (vL)
gacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaag

SEQ ID NO: 47 - DNA, 342 bp, Artificial Sequence
  Light Chain Variable Fragment (vL)
gatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagagcc

SEQ ID NO: 48 - DNA, 339 bp, Artificial Sequence
  Light Chain Variable Fragment (vL)
gatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagaga

SEQ ID NO: 49 - DNA, 318 bp, Artificial Sequence
  Light Chain Variable Fragment (vL)
gagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaag

SEQ ID NO: 50 - DNA, 324 bp, Artificial Sequence
  Light Chain Variable Fragment (vL)
cacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagaga

SEQ ID NO: 51 - DNA, 327 bp, Artificial Sequence
  Light Chain Variable Fragment (vL)
gaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagaga

SEQ ID NO: 52 - DNA, 336 bp, Artificial Sequence
  Light Chain Variable Fragment (vL)
gacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcgg

SEQ ID NO: 53 - DNA, 339 bp, Artificial Sequence
  Light Chain Variable Fragment (vL)
gacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggc

SEQ ID NO: 54 - DNA, 339 bp, Artificial Sequence
  Light Chain Variable Fragment (vL)
gacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagaga

SEQ ID NO: 55 - DNA, 342 bp, Artificial Sequence
  Light Chain Variable Fragment (vL)
gacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaaga

SEQ ID NO: 56 - DNA, 327 bp, Artificial Sequence
  Light Chain Variable Fragment (vL)
gagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagaga

SEQ ID NO: 57 - DNA, 324 bp, Artificial Sequence
  Light Chain Variable Fragment (vL)
gacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagaga

SEQ ID NO: 58 - DNA, 327 bp, Artificial Sequence
  Light Chain Variable Fragment (vL)
gacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagaga

SEQ ID NO: 59 - DNA, 318 bp, Artificial Sequence
  Light Chain Variable Fragment (vL)
cagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaag

SEQ ID NO: 60 - DNA, 312 bp, Artificial Sequence
  Light Chain Variable Fragment (vL)
atgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagaga

SEQ ID NO: 61 - DNA, 321 bp, Artificial Sequence
  Light Chain Variable Fragment (vL)
gacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaag

SEQ ID NO: 62 - DNA, 336 bp, Artificial Sequence
  Light Chain Variable Fragment (vL)
gacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaag

SEQ ID NO: 63 - DNA, 360 bp, Artificial Sequence
  Light Chain Variable Fragment (vL)
ctgaacttcatgctgacccagccccacagcgtgtccggcagccctggaaagaccgtgaccatctcctgcaccagaagcaccggcagcatcaccagcaactacgtgcactggtatcagcagaggcccggcagcagccctaccaccgtgatctgcgaggacaacgagaggccaagcggcgtgcccgatagattcagcggctccatcgacatcagcagcaacagcgccagcctgaccatcagcggcctgaaaaccgaggacgaggccgactactactgccagagctacgacgacagcaaccacatctccgtgttcggcaccgggaccaaagtgaccgtgctgggacagcccaaggccaatcct

SEQ ID NO: 64 - DNA, 321 bp, Artificial Sequence
  Light Chain Variable Fragment (vL)
gacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaag

SEQ ID NO: 65 - DNA, 324 bp, Artificial Sequence
  Light Chain Variable Fragment (vL)
gacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagaga

SEQ ID NO: 66 - DNA, 321 bp, Artificial Sequence
  Light Chain Variable Fragment (vL)
gacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaag

SEQ ID NO: 67 - DNA, 321 bp, Artificial Sequence
  Light Chain Variable Fragment (vL)
gacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaag

SEQ ID NO: 68 - DNA, 339 bp, Artificial Sequence
  Light Chain Variable Fragment (vL)
cagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagct

SEQ ID NO: 69 - DNA, 339 bp, Artificial Sequence
  Light Chain Variable Fragment (vL)
cagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagct

SEQ ID NO: 70 - DNA, 321 bp, Artificial Sequence
  Light Chain Variable Fragment (vL)
gacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagaga

SEQ ID NO: 71 - DNA, 324 bp, Artificial Sequence
  Light Chain Variable Fragment (vL)
gagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagaga

SEQ ID NO: 72 - DNA, 333 bp, Artificial Sequence
  Light Chain Variable Fragment (vL)
agcaccgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacctggccagcaacctgcagagcggcgtgcccagcagattttctggcagcggctccggcaccgacttcaccctgacaatcagctccctgcagcccgaggacttcgccacctactactgtcagcaggccgagtacatgcccctgaccttcggccagggaacaaaggtggaaatcaagagagcc

SEQ ID NO: 73 - DNA, 321 bp, Artificial Sequence
  Light Chain Variable Fragment (vL)
gacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaag

SEQ ID NO: 74 - DNA, 333 bp, Artificial Sequence
  Light Chain Variable Fragment (vL)
gacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatc

SEQ ID NO: 75 - DNA, 315 bp, Artificial Sequence
  Light Chain Variable Fragment (vL)
gacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaa

SEQ ID NO: 76 - DNA, 336 bp, Artificial Sequence
  Light Chain Variable Fragment (vL)
gatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaag

SEQ ID NO: 77 - DNA, 321 bp, Artificial Sequence
  Light Chain Variable Fragment (vL)
gagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcag

SEQ ID NO: 78 - DNA, 339 bp, Artificial Sequence
  Light Chain Variable Fragment (vL)
gagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaag

SEQ ID NO: 79 - DNA, 336 bp, Artificial Sequence
  Light Chain Variable Fragment (vL)
gacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaag

SEQ ID NO: 80 - DNA, 321 bp, Artificial Sequence
  Light Chain Variable Fragment (vL)
gacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaag

SEQ ID NO: 81 - DNA, 309 bp, Artificial Sequence
  Light Chain Variable Fragment (vL)
tacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaa

SEQ ID NO: 82 - DNA, 336 bp, Artificial Sequence
  Light Chain Variable Fragment (vL)
gacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagagg

SEQ ID NO: 83 - DNA, 327 bp, Artificial Sequence
  Light Chain Variable Fragment (vL)
ctggaaaccaccctgacacagagccctgccaccctgagtgtgtccccaggcgagagagtgaccctgagctgtagagccagccagagcgtgggcagcaacctggcctggtatcagcagaagttcggccaggcccccagactgctgatctacgacgccagcacaagagccaccggcatccccgccagattttctggcagcggctccggcaccgagttcaccctgaccatcagcagactggaacccgaggacttcgccgtgtactactgccaccagtacggcagcagccccagaacctttggacagggcaccaaggtggacatcaagcgg

SEQ ID NO: 84 - DNA, 339 bp, Artificial Sequence
  Light Chain Variable Fragment (vL)
gacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaag

SEQ ID NO: 85 - DNA, 315 bp, Artificial Sequence
  Light Chain Variable Fragment (vL)
gagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagagg

SEQ ID NO: 86 - DNA, 324 bp, Artificial Sequence
  Light Chain Variable Fragment (vL)
gacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagaga

SEQ ID NO: 87 - DNA, 333 bp, Artificial Sequence
  Light Chain Variable Fragment (vL)
cagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatcccgagcgtgcaggccgacgacgaggccggatatgtgtgcggcgctgacgacaatggcggctacgtgttcggcggaggcacccaactgacagtgaca

SEQ ID NO: 88 - DNA, 333 bp, Artificial Sequence
  Light Chain Variable Fragment (vL)
cagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgaca

SEQ ID NO: 89 - DNA, 333 bp, Artificial Sequence
  Light Chain Variable Fragment (vL)
cagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgaca

SEQ ID NO: 90 - DNA, 321 bp, Artificial Sequence
  Light Chain Variable Fragment (vL)
gacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaag

SEQ ID NO: 91 - DNA, 321 bp, Artificial Sequence; identical to SEQ ID NO: 42
  Light Chain Variable Fragment (vL)

SEQ ID NO: 92 - DNA, 336 bp, Artificial Sequence
  Light Chain Variable Fragment (vL)
aacttcatgctgacccagccccacagcgtgtccgagagccctggcaagaccgtgaccatctcctgtaccggcagcggcggcagcatcgacaacaactacgtgcactggtatcagcagaggcccggcagcgcccctaccaccgtgatgttcgaggacaaccagaggcccagcggcgtgcccgatagattcagcggctctatcgacagcagcagcaacagcgccagcctcgtgatctccggcctgaaaaccgaggacgagggcgactactactgccagagcagcgacggctccaaggtggtgtttggcggaggcaccaagctgaccgtgctgggacag

SEQ ID NO: 93 - DNA, 321 bp, Artificial Sequence
  Light Chain Variable Fragment (vL)
aacatcgagctgacccagagccccgccatcatgagtgcctctccaggcgagcgcgtgaccatgacatgtagcgccagcagcagcatccggtacatctactggtatcagcagaagcccggcagcagccccagactgctgatctacgacaccagcaacgtggcccctggcgtgccctttagattttccggcagcggctccggcaccagctacagcctgaccatcaaccggatggaagccgaggacgccgccacctactattgtcaggaatggagcggctacccctacaccttcggcggaggcaccaagctggacatcaagaga

SEQ ID NO: 94 - DNA, 336 bp, Artificial Sequence
  Light Chain Variable Fragment (vL)
gacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaag

SEQ ID NO: 95 - DNA, 321 bp, Artificial Sequence
  Light Chain Variable Fragment (vL)
gacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagaga

SEQ ID NO: 96 - DNA, 333 bp, Artificial Sequence
  Light Chain Variable Fragment (vL)
cagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggt

SEQ ID NO: 97 - DNA, 333 bp, Artificial Sequence
  Light Chain Variable Fragment (vL)
cagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggt

SEQ ID NO: 98 - DNA, 321 bp, Artificial Sequence
  Light Chain Variable Fragment (vL)
gacatccagatgacccagagccccagcagcctgtctgccagcgtgggcgacagagtgaccatcacctgtagagccagccaggacgtgaacaccgccgtggcctggtatcagcagaagcctggcaaggcccccaagctgctgatctacagcgccagcttcctggaaagcggcgtgcccagcagattcagcggaagcagaagcggcaccgacttcaccctgaccatcagctccctccagcccgaggacttcgccacctactactgccagcagcactacaccacccctcccaccttcggccagaccaaggtggaaatcaagaga

SEQ ID NO: 99 - DNA, 315 bp, Artificial Sequence
  Light Chain Variable Fragment (vL)
gacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcct

SEQ ID NO: 100 - DNA, 321 bp, Artificial Sequence
  Light Chain Variable Fragment (vL)
cagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtct

SEQ ID NO: 101 - DNA, 315 bp, Artificial Sequence
  Light Chain Variable Fragment (vL)
cagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctg

SEQ ID NO: 102 - DNA, 312 bp, Artificial Sequence
  Light Chain Variable Fragment (vL)
gagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaaga

SEQ ID NO: 103 - DNA, 321 bp, Artificial Sequence
  Light Chain Variable Fragment (vL)
gagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatc

SEQ ID NO: 104 - DNA, 324 bp, Artificial Sequence
  Light Chain Variable Fragment (vL)
gacatcgtgatgacccagagccaggacagcatggctaccagcgtgggcgagcgcgtgaccgtgaattgcaaggccagccagaacgtggacaccaacgtggcctggtatcagcagaagcccggccagtctcctgagcccctgctgttcagcgccagctacagatacaccggcgtgcccgacagattcagcggcagcggctctggcaccgacttcaccctgacaatcagcagcgtgcaggccgaggacgtggccgagtatttctgccagcagtacaacagctaccccctgaccttcggccagggcaccaagctggaaatcaagaga

SEQ ID NO: 105 - DNA, 327 bp, Artificial Sequence
  Light Chain Variable Fragment (vL)
gagatcgtgctgacacagagccctgccaccctgtctctgagccctggcgaaagagccaccctgagctgtagagccagccagagcgtgggcagctacctggcctggtatcagcagaagcctggcgctccccggctgctgatctacgatgcctctcacagagccaccggcatccccgccagattttctggcagcggctccggcaccgacttcaccctgacaatcagctccctggaacccgaggacttcgccgtgtactactgccagcagcggagcaactggccccccatgtataccttcggccagggcaccaagctggaaatcaagaga

SEQ ID NO: 106 - DNA, 339 bp, Artificial Sequence
  Light Chain Variable Fragment (vL)
gagatcgtgctgacccagagccctctgagcctgcctgtgacacctggcgagcctgccagcatctcctgtagaagcagccagagcctgctgcacagcaacggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagaccccccggacctttggacagggcaccaaggtggaaatcaagcgg

SEQ ID NO: 107 - DNA, 291 bp, Artificial Sequence
  Light Chain Variable Fragment (vL)
gacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaa

SEQ ID NO: 108 - DNA, 327 bp, Artificial Sequence
  Light Chain Variable Fragment (vL)
gacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagaga

SEQ ID NO: 109 - DNA, 321 bp, Artificial Sequence
  Light Chain Variable Fragment (vL)
gacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaag

SEQ ID NO: 110 - DNA, 321 bp, Artificial Sequence
  Light Chain Variable Fragment (vL)
gacattcaaatgacgcagagcccctcctctctgtcagcgagcgtgggagatagtgtcacgattacttgtcaggccagccaagacatttcctcatatctgaactggtatcagcagaagcccggcaaggcccccgaactgttgatctactacggcagcgagttggaatccggcgttccttctcgcttttccgggtccggctctggaacagatttcaccttcaccatttctagccttgaagcagaagacgccgccacttactactgcgggcaaggtaaccgattgccgtacaccttcggccagggtacaaaagtggaaatcgag

SEQ ID NO: 111 - DNA, 309 bp, Artificial Sequence
  Light Chain Variable Fragment (vL)
gacatccagatgacacagagccctagcagcctgtctgccagcgtgggagacagagtgaccatcacctgtagaaccagccagagcctgagcagctacacccactggtatcagcagaagcctggcaaggcccctaagctgctgatctatgccgcttccagcagaggcagcggagtgcctagcagattttctggcagcggctccggcaccgatttcaccctgacaatatccagcctccagcctgaggacttcgccacctactactgccagcagagcagaacattcggccagggcaccaaggtggaaatcaaa

SEQ ID NO: 112 - DNA, 318 bp, Artificial Sequence
  Light Chain Variable Fragment (vL)
atccaaatgacacaatcttcatcctacttgtctgtttctctaggaggcagagtcaccatcacttgcaaggcaagtgcccacatcaataattggttagcctggtatcagcagaaaccaggaaatgctcctagactcttaatatctggtgcaaccagtttggaaactggggttccttcaagattcagtggcagtggatctggaaaggattacactctcagcattaacagtcttcagactgaagatgttgctacttattattgtcaacagtattggagtcttcctcggacgttcggtggaggcaccaggctggaaatcaaa

SEQ ID NO: 113 - DNA, 339 bp, Artificial Sequence
  Light Chain Variable Fragment (vL)
gacatcgtgatgacccagagccccagcagcctgaccatgagcgtgggccagaaagtgaccatgtcctgcaagagcagccacagcctgctgaacagccggaaccagaagaactacctggcctggttccagcagaagcccggccagtcccccaagctgctggtgtacttcgcaagcacccgcgagagcggcgtgcccgacagattcatcggcagcggctccggcaccgacttcaccctgaccatcagcaacgtgcaggccgaggacctggccgactacttctgccagcagcactacaccaccctgcccaccttcggcggaggcaccaagctggaaatcaag

SEQ ID NO: 114 - DNA, 324 bp, Artificial Sequence
  Light Chain Variable Fragment (vL)
gacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagaga

SEQ ID NO: 115 - DNA, 321 bp, Artificial Sequence
  Light Chain Variable Fragment (vL)
gacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagaga

SEQ ID NO: 116 - DNA, 321 bp, Artificial Sequence
  Light Chain Variable Fragment (vL)
gacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaag

SEQ ID NO: 117 - DNA, 336 bp, Artificial Sequence
  Light Chain Variable Fragment (vL)
gacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcacc

SEQ ID NO: 118 - DNA, 321 bp, Artificial Sequence
  Light Chain Variable Fragment (vL)
gacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcga

SEQ ID NO: 119 - DNA, 321 bp, Artificial Sequence
  Light Chain Variable Fragment (vL)
gacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaa

SEQ ID NO: 120 - DNA, 348 bp, Artificial Sequence
  Light Chain Variable Fragment (vL)
gaccagagcgtgctgacacagcctccatccgtgtctggcgctccaggccagagagtgaccatctcctgtaccggcagcagcagcaacatcggagccggctatgacgtgcactggtatcagcaactgcccggcaccgcccccaagctgctgatctacggcaacagcaacagacccagcggcgtgcccgatagattcagcggcagcaagagcggcacaagcgccagcctggctatcactggactccaggccgaggacgaggccgactactactgccagagctacgacaacagcctgtcctcctgggtgttcggcggaggcaccaagctgacagtgctgggccagcctaag

SEQ ID NO: 121 - DNA, 345 bp, Artificial Sequence
  Light Chain Variable Fragment (vL)
gaccagagcgtcgtgacacagcctccatctgtgtctgccgcccctggccggaaagtgaccatctcttgtagcggcagcagcagcaacatcggcagcaactacgtgtcctggtatcagcaggtgcccggcaccgcccctaagctgctgatctacgaggacgacaagcggcccagcggcatccccgatagattcagcggctctaagagcggcaccagcgccacactgggcatcaccggactccagacaggcgacgaggccgactacttctgcgccacctgggacagaaccgtgaacgtggtgcgctttggcggcggaaccagactgacagtgcacagccagcctaag

SEQ ID NO: 122 - DNA, 324 bp, Artificial Sequence
  Light Chain Variable Fragment (vL)
gacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagaga

SEQ ID NO: 123 - DNA, 324 bp, Artificial Sequence
  Light Chain Variable Fragment (vL)
gacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagaga

SEQ ID NO: 124 - DNA, 321 bp, Artificial Sequence
  Light Chain Variable Fragment (vL)
gatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaac

SEQ ID NO: 125 - DNA, 321 bp, Artificial Sequence
  Light Chain Variable Fragment (vL)
gacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaac

SEQ ID NO: 126 - DNA, 318 bp, Artificial Sequence
  Light Chain Variable Fragment (vL)
cagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaa

SEQ ID NO: 127 - DNA, 336 bp, Artificial Sequence
  Light Chain Variable Fragment (vL)
gacatcgtaatgacccaggctgccccatccataccagtcactcccggtgaatccgtgtctatatcttgtaggtccgataagagtctgcttcacagcaacggcaatacttatcttttctggtttttgcagcgaccgggacaaagcccacaactgctgatctatagaatgtcaaatcttgcatcaggggtcccagatcgctttagtggatctgggtcaggcacagctttcaccctgagaatctccggagtggaagcagaagacgtaggcgtgtattactgtatgcagcaccttgagtatccttatacctttggaggcggaactaagctcgaaattaaa

SEQ ID NO: 128 - DNA, 336 bp, Artificial Sequence
  Light Chain Variable Fragment (vL)
gacatcgtaatgacacagtctcccctgtccctccctgtcacaccaggtgaacctgccagtatttcttgtagatccagtaagtcacttctgcactccaatgggaacacctacctgtattggttccagcaaaagcctggtcaggcacctcgcttgcttatttataggatgtccaatcttgcatccggcgtgccagaccgattctcaggctccggctctggtactgcatttaccctgaaaatctcccgcgtggaagcagaagatgtgggcgtgtactactgtatgcagcacatcgagtaccccttcacgtttggtcaaggcacaaagctggaaatcaaa

SEQ ID NO: 129 - DNA, 345 bp, Artificial Sequence
  Light Chain Variable Fragment (vL)
tcctcctacgtgctgactcagcctccctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcacccgagttttcggcggagggaccaagctgaccgtcctaggtgccgccgca

SEQ ID NO: 130 - DNA, 333 bp, Artificial Sequence
  Light Chain Variable Fragment (vL)
gacatcgtactgacacagagccccgcttctctggcagtgtcactgggccagtccgttacaatatcctgtcgggcgagtgaatccgtggaatactatggaacaagtctcatgcagtggtatcagcagaaacctggacagccccccaagctgctcatctacggtgcgtcaaatgtcgagagtggggttccggcccgattcagtggttccgggagtggcacagactttagcctcaacatccatcctgttgaggaagacgatattgccatgtatttttgccaacagtcccgcaaagtcccctggacctttggtggaggaactaagctggagatcaag

SEQ ID NO: 131 - DNA, 327 bp, Artificial Sequence
  Light Chain Variable Fragment (vL)
gagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagaga

SEQ ID NO: 132 - DNA, 324 bp, Artificial Sequence
  Light Chain Variable Fragment (vL)
gagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcgg

SEQ ID NO: 133 - DNA, 339 bp, Artificial Sequence
  Light Chain Variable Fragment (vL)
gacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagaga

SEQ ID NO: 134 - DNA, 327 bp, Artificial Sequence
  Light Chain Variable Fragment (vL)
gagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagaga

SEQ ID NO: 135 - DNA, 336 bp, Artificial Sequence
  Light Chain Variable Fragment (vL)
gacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaag

SEQ ID NO: 136 - DNA, 330 bp, Artificial Sequence
  Light Chain Variable Fragment (vL)
gaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctg

SEQ ID NO: 137 - DNA, 291 bp, Artificial Sequence
  Light Chain Variable Fragment (vL)
gagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcgaggacttcgccgtgtactactgccagcagagcaccttcggccagggcaccaaggtggaaatcaag

SEQ ID NO: 138 - DNA, 321 bp, Artificial Sequence
  Light Chain Variable Fragment (vL)
gagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacctttggacagggcaccaaggtggaaatcaag

SEQ ID NO: 139 - DNA, 321 bp, Artificial Sequence
  Light Chain Variable Fragment (vL)
gacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaa

SEQ ID NO: 140 - DNA, 324 bp, Artificial Sequence
  Light Chain Variable Fragment (vL)
gacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagaga

SEQ ID NO: 141 - DNA, 336 bp, Artificial Sequence
  Light Chain Variable Fragment (vL)
gccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttaga

SEQ ID NO: 142 - DNA, 324 bp, Artificial Sequence
  Light Chain Variable Fragment (vL)
gacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaag

SEQ ID NO: 143 - DNA, 318 bp, Artificial Sequence
  Light Chain Variable Fragment (vL)
cagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcgg

SEQ ID NO: 144 - DNA, 339 bp, Artificial Sequence
  Light Chain Variable Fragment (vL)
gacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagaga

SEQ ID NO: 145 - DNA, 321 bp, Artificial Sequence
  Light Chain Variable Fragment (vL)
gacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaag

SEQ ID NO: 146 - DNA, 321 bp, Artificial Sequence
  Light Chain Variable Fragment (vL)
gacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaag

SEQ ID NO: 147 - DNA, 354 bp, Artificial Sequence
  Light Chain Variable Fragment (vL)
gacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagaggcggaggcggaagtggaggcggaggatctggcggcggaggctct

SEQ ID NO: 148 - DNA, 324 bp, Artificial Sequence
  Light Chain Variable Fragment (vL)
gacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagaga

SEQ ID NO: 149 - DNA, 321 bp, Artificial Sequence
  Light Chain Variable Fragment (vL)
gacatcaagatgacccagagccccagctctatgtacgccagcctgggcgagcgcgtgaccatcacctgtaaagccagccccgacatcaacagctacctgagctggttccagcagaagcccggcaagagccccaagaccctgatctaccgggccaacagactggtggatggcgtgcccagcagattctctggcggcggaagcggccaggactacagcctgaccatcaactccctggaatacgaggacatgggcatctactactgcctccagtacgacgagttcccctacaccttcggcggaggcaccaagctggaaatgaaa

SEQ ID NO: 150 - DNA, 324 bp, Artificial Sequence
  Light Chain Variable Fragment (vL)
gacgtggtcgtgacccctgtgtcctgcttcctgagctgcatctctggcgccgagggccaccacctgattcagggccagcagaagtgccagtacatctggctgctgtacgccctggaacccaccgagacaagaaccgccacccagacccctcacctgtcctgcatccagcccagaatctggggaccctgccaggtgcagtggcagtgggtgtgggatagactgcacccccagcaccctagttgtggcggcggaggctgttgcaacctgctgctgtctgcccacggcgcctacacatttggcggaggcacccggctggaactgaaa

SEQ ID NO: 151 - DNA, 321 bp, Artificial Sequence
  Light Chain Variable Fragment (vL)
cagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctg

SEQ ID NO: 152 - DNA, 324 bp, Artificial Sequence
  Light Chain Variable Fragment (vL)
gagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaag

SEQ ID NO: 153 - DNA, 318 bp, Artificial Sequence
  Light Chain Variable Fragment (vL)
gagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaa

SEQ ID NO: 154 - DNA, 324 bp, Artificial Sequence
  Light Chain Variable Fragment (vL)
gacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagaga

SEQ ID NO: 155 - DNA, 339 bp, Artificial Sequence
  Light Chain Variable Fragment (vL)
gacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcgg

SEQ ID NO: 156 - DNA, 327 bp, Artificial Sequence
  Light Chain Variable Fragment (vL)
agctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacag

SEQ ID NO: 157 - DNA, 339 bp, Artificial Sequence
  Light Chain Variable Fragment (vL)
aacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacag

SEQ ID NO: 158 - DNA, 324 bp, Artificial Sequence
  Light Chain Variable Fragment (vL)
gacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagaga

SEQ ID NO: 159 - DNA, 327 bp, Artificial Sequence
  Light Chain Variable Fragment (vL)
gagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctacacattcggccagggcaccaagctggaaatcaagaga

SEQ ID NO: 160 - DNA, 324 bp, Artificial Sequence
  Light Chain Variable Fragment (vL)
gacatccagatgacccagagccccagcatcctgagcgccagcgtgggcgacagagtgaccatcacctgtcgggccagccagagattcggcgactacctggcctggtatcagcagaagcctggacaggcccccaagctgctgatctacggcgcttccacactccagagcggcgtgcccagcagattttctggcagcggctccggcaccgagttcaccctgacaatcagcggcctccagcccgaggacttcgccacctactattgccagcaggccaacagcttccctatcaccttcggcaagggcacccggctggacatcagaaga

SEQ ID NO: 161 - DNA, 321 bp, Artificial Sequence
  Light Chain Variable Fragment (vL)
gagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaag

SEQ ID NO: 162 - DNA, 342 bp, Artificial Sequence
  Light Chain Variable Fragment (vL)
gacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagaga

SEQ ID NO: 163 - DNA, 321 bp, Artificial Sequence
  Light Chain Variable Fragment (vL)
gagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaag

SEQ ID NO: 164 - DNA, 324 bp, Artificial Sequence
  Light Chain Variable Fragment (vL)
gacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagaga

SEQ ID NO: 165 - DNA, 339 bp, Artificial Sequence
  Light Chain Variable Fragment (vL)
gacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagcggcaccgacttcaccctgaccatcagttctcttcaggccgaggacgtggccgtgtactactgccagaacgactacagctaccccctgaccttcggccagggcaccaaggtggaaatcaag

SEQ ID NO: 166 - DNA, 321 bp, Artificial Sequence
  Light Chain Variable Fragment (vL)
gacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaag

SEQ ID NO: 167 - DNA, 333 bp, Artificial Sequence
  Light Chain Variable Fragment (vL)
gacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaag

SEQ ID NO: 168 - DNA, 327 bp, Artificial Sequence
  Light Chain Variable Fragment (vL)
gccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagaga

SEQ ID NO: 169 - DNA, 321 bp, Artificial Sequence
  Light Chain Variable Fragment (vL)
cagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctg

SEQ ID NO: 170 - DNA, 321 bp, Artificial Sequence
  Light Chain Variable Fragment (vL)
gacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaag

SEQ ID NO: 171 - DNA, 324 bp, Artificial Sequence
  Light Chain Variable Fragment (vL)
gacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcgg

SEQ ID NO: 172 - DNA, 339 bp, Artificial Sequence
  Light Chain Variable Fragment (vL)
gagatcgtgctgacccagagccctctgagcctgcctgtgacacctggcgagcctgccagcatctcctgtagaagcagccagagcctgctgcacagcatcggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccccctgacctttggcggaggcaccaaggtggaaatcaagcgg

SEQ ID NO: 173 - DNA, 339 bp, Artificial Sequence
  Light Chain Variable Fragment (vL)
gacgtcgtgatgacccagagccctctgagcctgcctgtgacacctggcgagcctgccagcatctcctgtagaagcagccagagcctgctgcacagcatcggctacaactacctgcactggtttctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccctcccacctttggacagggcaccagactggaaatcaagcgg

SEQ ID NO: 174 - DNA, 339 bp, Artificial Sequence
  Light Chain Variable Fragment (vL)
gacgtcgtgatgacccagagccctctgagcctgcctgtgacacctggcgagcctgccagcatcagctgtagaagcagccagagcctgctgcacagcaacggccacaactacctggactggtatctccagaagcccggccagagcccccagctgctgatctacctgggcagcaatagagccagcggcgtgcccgatagattcagcggctctggaagcggcaccgacttcaccctgaagatcagccgggtggaagccgaggacgtgggcgtgtactactgtatgcagaccctccagacccccctgacctttggccctggcaccaaggtggacatcaagaga

SEQ ID NO: 175 - DNA, 321 bp, Artificial Sequence
  Light Chain Variable Fragment (vL)
gagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaag

SEQ ID NO: 176 - DNA, 330 bp, Artificial Sequence
  Light Chain Variable Fragment (vL)
caggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctg

SEQ ID NO: 177 - DNA, 321 bp, Artificial Sequence
  Light Chain Variable Fragment (vL)
gacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagaga

SEQ ID NO: 178 - DNA, 333 bp, Artificial Sequence
  Light Chain Variable Fragment (vL)
cagaccgtcgtgacacagcctcctagcgcctctggcacaccaggccagagagtgaccatctcctgtagcggcagcagcagcaacatcggcagcaactacgtgtactggtatcagcaactgcccggcaccgcccccaagctgctgatctacagaagcaaccagcggcccagcggcgtgcccgatagattttctggcagcaagagcggcaccagcgccagcctggctatctctggacctagaagcgtggacgaggccgactactactgcgccgcctgggacgatagcctgaacggcgtggtgtttggcggaggcaccaagctgacagtgctgggt

SEQ ID NO: 179 - DNA, 327 bp, Artificial Sequence
  Light Chain Variable Fragment (vL)
cagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggt

SEQ ID NO: 180 - DNA, 327 bp, Artificial Sequence
  Light Chain Variable Fragment (vL)
caggccgtgctgacccaggagagcgccctgaccaccagccccggcgagaccgtgaccctgacctgcagaagcagcaccggcgccgtgaccaccagcaactacgccaactgggtgcaggagaagcccgaccacctgttcaccggcctgatcggcggcaccaacaacagagtgcccggcgtgcccgccagattcagcggcagcctgatcggcgacaaggccgccctgaccatcaccggcgcccagaccgaggacgaggccatctacttctgcgtgctgtggcacagcaaccactgggtgttcggcggcggcaccaagctgaccgtgctg

SEQ ID NO: 181 - DNA, 333 bp, Artificial Sequence
  Light Chain Variable Fragment (vL)
gacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaa

SEQ ID NO: 182 - DNA, 324 bp, Artificial Sequence
  Light Chain Variable Fragment (vL)
gagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagaga

SEQ ID NO: 183 - DNA, 324 bp, Artificial Sequence
  Light Chain Variable Fragment (vL)
gagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaa

SEQ ID NO: 184 - DNA, 321 bp, Artificial Sequence
  Light Chain Variable Fragment (vL)
gacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaa

SEQ ID NO: 185 - DNA, 318 bp, Artificial Sequence
  Light Chain Variable Fragment (vL)
gacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaa

SEQ ID NO: 186 - DNA, 318 bp, Artificial Sequence
  Light Chain Variable Fragment (vL)
gacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaa

SEQ ID NO: 187 - DNA, 324 bp, Artificial Sequence
  Light Chain Variable Fragment (vL)
gacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagaga

SEQ ID NO: 188 - DNA, 336 bp, Artificial Sequence
  Light Chain Variable Fragment (vL)
gacatccagctcacacagagcccttctagcctgtctgccagcgtgggcgacagagtgaccatcacatgtagagccagccagagcgtggactacgacggcgacagctacatgaactggtatcagcagaagcccggcaaggcccctaagctgctgatctacgccgccagctatctggaaagcggcgtgccaagcagattttccggctctggcagcggcaccgatttcaccctgacaatatccagcctccagcctgaggacttcgccacctactactgccagcagagccatgaggacccctacacctttggacagggcaccaaggtggaaatcaagaga

SEQ ID NO: 189 - DNA, 321 bp, Artificial Sequence
  Light Chain Variable Fragment (vL)
gacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaa

SEQ ID NO: 190-210 - skipped (21 entries)

SEQ ID NO: 211 - DNA, 45 bp, Artificial Sequence
  Glycine Serine Linker
ggcggaggcggaagtggaggcggaggatctggcggcggaggctct

SEQ ID NO: 212 - DNA, 45 bp, Artificial Sequence
  Glycine Serine Linker
ggaggcggaggaagtggcggcggaggatctgggggaggcggaagc

SEQ ID NO: 213 - DNA, 45 bp, Artificial Sequence
  Glycine Serine Linker
ggtggcggtggctcgggcggtggtgggtcgggtggcggcggatct

SEQ ID NO: 214 - DNA, 45 bp, Artificial Sequence
  Glycine Serine Linker
ggcggcggaggatctggcggaggcggatctgggggcggaggctct

SEQ ID NO: 215 - DNA, 45 bp, Artificial Sequence
  Glycine Serine Linker
ggcggtggcggttcaggtggagggggaagcggtggtggtggctca

SEQ ID NO: 216 - DNA, 45 bp, Artificial Sequence
  Glycine Serine Linker
ggcggcggaggctcaggcggaggcggatctggcgggggaggatct

SEQ ID NO: 217 - DNA, 105 bp, Artificial Sequence
  Glycine Serine Linker
ggaggtagcggctccgggggaggcggaagtggaggcggaggatctgggtctggaggaagcggatctggaggctcagggtcagggggctcaggcagtggaggctct

SEQ ID NO: 218 - DNA, 105 bp, Artificial Sequence
  Glycine Serine Linker
ggaggaggcggctccgggggaggcggaagtggaggcggaggatctgggtctggaggaagcggatctggaggctcagggtcagggggctcaggcagtggaggctct

SEQ ID NO: 219 - skipped

SEQ ID NO: 220 - DNA, 21 bp, Artificial Sequence
  PG4SP linker
cctggcggaggcgggtctcct

SEQ ID NO: 221 - DNA, 21 bp, Artificial Sequence
  PG4SP-v2 linker
cctggtggcggaggatctcct

SEQ ID NO: 222 - DNA, 21 bp, Artificial Sequence
  E-coil Linker
gaggttgcggcgctcgaaagg

SEQ ID NO: 223 - DNA, 21 bp, Artificial Sequence
  K-coil Linker
cgtgtggctgcgctcaaggag

SEQ ID NO: 224 - DNA, 15 bp, Artificial Sequence
  EAAAK Linker
gaggccgcagcaaag

SEQ ID NO: 225 - DNA, 15 bp, Artificial Sequence
  EAAAK-v2 Linker
gaagcagccgccaag

SEQ ID NO: 226 - DNA, 375 bp, Artificial Sequence
  Heavy Chain Variable Fragment (vH)
gggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctct

SEQ ID NO: 227 - DNA, 360 bp, Artificial Sequence
  Heavy Chain Variable Fragment (vH)
gctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagt

SEQ ID NO: 228 - DNA, 369 bp, Artificial Sequence
  Heavy Chain Variable Fragment (vH)
gaagtgcagctggtggagtctgggggaggcttggtccagcctggggggtccctgagactctcctgttcagcctctggattcacctttagtagctttggaatgcactgggtccgccaggctccagggaaggggctggaatgggtggcctacattagtagtggcagtagtaccatctactatggagacaccgtgaagggccgattcaccatctccagagacaacgccaagaactcactgtttctgcaaatgagcagcctgagagccgaggacacggccgtgtattattgtgcgagagaggggggatattactacggaaggagttactatactatggactactggggccaagggaccacggtcaccgtctcc

SEQ ID NO: 229 - DNA, 354 bp, Artificial Sequence
  Heavy Chain Variable Fragment (vH)
caagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatct

SEQ ID NO: 230 - DNA, 351 bp, Artificial Sequence
  Heavy Chain Variable Fragment (vH)
gaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatct

SEQ ID NO: 231 - DNA, 351 bp, Artificial Sequence
  Heavy Chain Variable Fragment (vH)
caggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctct

SEQ ID NO: 232 - DNA, 363 bp, Artificial Sequence
  Heavy Chain Variable Fragment (vH)
caggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagc

SEQ ID NO: 233 - DNA, 354 bp, Artificial Sequence
  Heavy Chain Variable Fragment (vH)
caggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctct

SEQ ID NO: 234 - DNA, 360 bp, Artificial Sequence
  Heavy Chain Variable Fragment (vH)
gaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagc

SEQ ID NO: 235 - DNA, 366 bp, Artificial Sequence
  Heavy Chain Variable Fragment (vH)
caggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagc

SEQ ID NO: 236 - DNA, 354 bp, Artificial Sequence
  Heavy Chain Variable Fragment (vH)
gaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctct

SEQ ID NO: 237 - DNA, 363 bp, Artificial Sequence
  Heavy Chain Variable Fragment (vH)
gaagtgcaactccagcagagcggccctgagctgattaagcctggggccagcgtgaagatgagctgcaaggccagcggctacaccttcaccagctacgtgatgcactgggtcaagcagaagcccggccagggcctggaatggatcggctacatcaacccctacaacgatggcaccaagtacaacgagaagttcaagggcaaggccaccctgaccagcgacaagagcagcagcaccgcctacatggaactgagcagcctgacaagcgaggacagcgccgtgtactattgcgccagaggcacctactactacggcagccgggtgttcgactattggggccagggcaccacactgaccgtgtcctct

SEQ ID NO: 238 - DNA, 360 bp, Artificial Sequence
  Heavy Chain Variable Fragment (vH)
caggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagt

SEQ ID NO: 239 - DNA, 360 bp, Artificial Sequence
  Heavy Chain Variable Fragment (vH)
caggtgcagctccaggaatctggccctggcctcgtgaagcctagtcagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagt

SEQ ID NO: 240 - DNA, 372 bp, Artificial Sequence
  Heavy Chain Variable Fragment (vH)
caggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagt

SEQ ID NO: 241 - DNA, 360 bp, Artificial Sequence
  Heavy Chain Variable Fragment (vH)
gaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctca

SEQ ID NO: 242 - DNA, 357 bp, Artificial Sequence
  Heavy Chain Variable Fragment (vH)
gtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctca

SEQ ID NO: 243 - DNA, 360 bp, Artificial Sequence
  Heavy Chain Variable Fragment (vH)
caggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagt

SEQ ID NO: 244 - DNA, 366 bp, Artificial Sequence
  Heavy Chain Variable Fragment (vH)
gaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatct

SEQ ID NO: 245 - DNA, 357 bp, Artificial Sequence
  Heavy Chain Variable Fragment (vH)
caggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagc

SEQ ID NO: 246 - DNA, 360 bp, Artificial Sequence
  Heavy Chain Variable Fragment (vH)
gaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagc

SEQ ID NO: 247 - DNA, 351 bp, Artificial Sequence
  Heavy Chain Variable Fragment (vH)
caggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctct

SEQ ID NO: 248 - DNA, 372 bp, Artificial Sequence
  Heavy Chain Variable Fragment (vH)
caggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagc

SEQ ID NO: 249 - DNA, 351 bp, Artificial Sequence
  Heavy Chain Variable Fragment (vH)
caggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagc

SEQ ID NO: 250 - DNA, 336 bp, Artificial Sequence
  Heavy Chain Variable Fragment (vH)
caggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagc

SEQ ID NO: 251 - DNA, 351 bp, Artificial Sequence
  Heavy Chain Variable Fragment (vH)
caggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctct

SEQ ID NO: 252 - DNA, 357 bp, Artificial Sequence
  Heavy Chain Variable Fragment (vH)
gaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatct

SEQ ID NO: 253 - DNA, 360 bp, Artificial Sequence
  Heavy Chain Variable Fragment (vH)
gaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagt

SEQ ID NO: 254 - DNA, 348 bp, Artificial Sequence
  Heavy Chain Variable Fragment (vH)
gatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgct

SEQ ID NO: 255 - DNA, 354 bp, Artificial Sequence
  Heavy Chain Variable Fragment (vH)
caggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatct

SEQ ID NO: 256 - DNA, 366 bp, Artificial Sequence
  Heavy Chain Variable Fragment (vH)
caggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctct

SEQ ID NO: 257 - DNA, 366 bp, Artificial Sequence
  Heavy Chain Variable Fragment (vH)
cagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctct

SEQ ID NO: 258 - DNA, 342 bp, Artificial Sequence
  Heavy Chain Variable Fragment (vH)
gaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctct

SEQ ID NO: 259 - DNA, 363 bp, Artificial Sequence
  Heavy Chain Variable Fragment (vH)
caggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagc

SEQ ID NO: 260 - DNA, 363 bp, Artificial Sequence; identical to SEQ ID NO: 259
  Heavy Chain Variable Fragment (vH)

SEQ ID NO: 261 - DNA, 354 bp, Artificial Sequence
  Heavy Chain Variable Fragment (vH)
caggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctct

SEQ ID NO: 262 - DNA, 339 bp, Artificial Sequence
  Heavy Chain Variable Fragment (vH)
caggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagc

SEQ ID NO: 263 - DNA, 351 bp, Artificial Sequence
  Heavy Chain Variable Fragment (vH)
gaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttca

SEQ ID NO: 264 - DNA, 369 bp, Artificial Sequence
  Heavy Chain Variable Fragment (vH)
gaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagt

SEQ ID NO: 265 - DNA, 375 bp, Artificial Sequence
  Heavy Chain Variable Fragment (vH)
caggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatct

SEQ ID NO: 266 - DNA, 348 bp, Artificial Sequence
  Heavy Chain Variable Fragment (vH)
caggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctct

SEQ ID NO: 267 - DNA, 354 bp, Artificial Sequence
  Heavy Chain Variable Fragment (vH)
caggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatct

SEQ ID NO: 268 - DNA, 354 bp, Artificial Sequence
  Heavy Chain Variable Fragment (vH)
caggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctct

SEQ ID NO: 269 - DNA, 345 bp, Artificial Sequence
  Heavy Chain Variable Fragment (vH)
gaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatct

SEQ ID NO: 270 - DNA, 360 bp, Artificial Sequence
  Heavy Chain Variable Fragment (vH)
gaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctct

SEQ ID NO: 271 - DNA, 360 bp, Artificial Sequence
  Heavy Chain Variable Fragment (vH)
gaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctct

SEQ ID NO: 272 - DNA, 366 bp, Artificial Sequence
  Heavy Chain Variable Fragment (vH)
caggtgcaactgcaggaatctggccctggcctcgtgaagcccagcgagacactgagcctgacctgcacagtgtccggcggcagcattagcagcagcaattactactggggctggattcggcagccccctggcaagggactggaatggatcggagccatctactacagcggcagcacctactacaaccccagcctgaagtccagagtggctatcagcgtggacaccagcaagaaccagttctccctgaagctgagcagcgtgacagccgccgataccgccgtgtactactgcgccagacggatcggagtggccggacagtggtacttcgacctgtggggcagaggaaccctcgtgaccgtgtctagc

SEQ ID NO: 273 - DNA, 366 bp, Artificial Sequence
  Heavy Chain Variable Fragment (vH)
cagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctca

SEQ ID NO: 274 - DNA, 357 bp, Artificial Sequence
  Heavy Chain Variable Fragment (vH)
gaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatct

SEQ ID NO: 275 - DNA, 360 bp, Artificial Sequence
  Heavy Chain Variable Fragment (vH)
caggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagc

SEQ ID NO: 276 - DNA, 360 bp, Artificial Sequence
  Heavy Chain Variable Fragment (vH)
caggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagc

SEQ ID NO: 277 - DNA, 360 bp, Artificial Sequence
  Heavy Chain Variable Fragment (vH)
caggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagc

SEQ ID NO: 278 - DNA, 372 bp, Artificial Sequence
  Heavy Chain Variable Fragment (vH)
cagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagt

SEQ ID NO: 279 - DNA, 354 bp, Artificial Sequence
  Heavy Chain Variable Fragment (vH)
caggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctct

SEQ ID NO: 280 - DNA, 345 bp, Artificial Sequence
  Heavy Chain Variable Fragment (vH)
gaagtgcaactgctggaatctggcggcggactggtgcagcctggcggatctctgagactgagctgtgccgccagcggcttcacctttagcggctacgccatgagctgggtgcgccaggctcctggcaaaggcctggaatgggtgtccgagatcgcccctcccggcctgaataccagatacgccgatagcgtgaagggccggttcaccatcagccgggacaacagcaagaacaccctgtacctgcagatgaacagcctgcgggccgaggataccgccgtgtactactgcgccaagagcgacaccgccttcgactactggggacagggaacccttgtgaccgtgtcc

SEQ ID NO: 281 - DNA, 357 bp, Artificial Sequence
  Heavy Chain Variable Fragment (vH)
caggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgct

SEQ ID NO: 282 - DNA, 369 bp, Artificial Sequence
  Heavy Chain Variable Fragment (vH)
caggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagt

SEQ ID NO: 283 - DNA, 348 bp, Artificial Sequence
  Heavy Chain Variable Fragment (vH)
gaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctct

SEQ ID NO: 284 - DNA, 342 bp, Artificial Sequence
  Heavy Chain Variable Fragment (vH)
gagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagc

SEQ ID NO: 285 - DNA, 381 bp, Artificial Sequence
  Heavy Chain Variable Fragment (vH)
gaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatct

SEQ ID NO: 286 - DNA, 360 bp, Artificial Sequence
  Heavy Chain Variable Fragment (vH)
gaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagt

SEQ ID NO: 287 - DNA, 351 bp, Artificial Sequence
  Heavy Chain Variable Fragment (vH)
gaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtct

SEQ ID NO: 288 - DNA, 372 bp, Artificial Sequence
  Heavy Chain Variable Fragment (vH)
gtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagt

SEQ ID NO: 289 - DNA, 366 bp, Artificial Sequence
  Heavy Chain Variable Fragment (vH)
agggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgct

SEQ ID NO: 290 - DNA, 354 bp, Artificial Sequence
  Heavy Chain Variable Fragment (vH)
caggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagt

SEQ ID NO: 291 - DNA, 372 bp, Artificial Sequence
  Heavy Chain Variable Fragment (vH)
caggtgcaactggtgcagagcggagccgaagtgaagaaacctggggccagcgtgaaggtgtcctgcaaggccagcggctacacctttaccacctacggcatctcttgggtgcgccaggctcctggacagggactggaatggatgggctggatcagcgcctacaacggccacaccaactacgcccagatgctccagggcagagtgaccatgaccaccgacaccagcacctccaccgcctacatggaactgcggggcctgagaagcgacgacaccgccgtgtattattgcgccagagaagcctacgcctcctacggcagcggcagctactggaccgattattggggccagggcaccctcgtgaccgtgtctagt

SEQ ID NO: 292 - DNA, 339 bp, Artificial Sequence
  Heavy Chain Variable Fragment (vH)
gaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagt

SEQ ID NO: 293 - DNA, 363 bp, Artificial Sequence
  Heavy Chain Variable Fragment (vH)
caggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctacgcgt

SEQ ID NO: 294 - DNA, 357 bp, Artificial Sequence
  Heavy Chain Variable Fragment (vH)
gaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatct

SEQ ID NO: 295 - DNA, 369 bp, Artificial Sequence
  Heavy Chain Variable Fragment (vH)
cagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagc

SEQ ID NO: 296 - DNA, 354 bp, Artificial Sequence
  Heavy Chain Variable Fragment (vH)
gagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatct

SEQ ID NO: 297 - DNA, 363 bp, Artificial Sequence
  Heavy Chain Variable Fragment (vH)
gaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatct

SEQ ID NO: 298 - DNA, 366 bp, Artificial Sequence
  Heavy Chain Variable Fragment (vH)
gaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagc

SEQ ID NO: 299 - DNA, 372 bp, Artificial Sequence
  Heavy Chain Variable Fragment (vH)
gaagtgcaactggtgcagagcggcggaggctctctgacactgtcttgtgctgcctccggcgtggtgcagcctggcagattcaccttcagcagctacggaatgcactgggtgcgccaggcccctggaaagggactggaatgggtgtccgtgatctcttacgacggcagcaacaagtattacgccgacagcgtgaagggccggttcaccatctccagagacaacagcaagaacaccctgtacctccagatgaacagcctgcggaccgaggacaccgccgtgtactactgtgccaagaccctgtccgctggcgagtggattggaggcggagccttcgatatctggggccacggcacaatggtcaccgtgtcctct

SEQ ID NO: 300 - DNA, 357 bp, Artificial Sequence
  Heavy Chain Variable Fragment (vH)
caagtgaagctccaggaatctggcggcggactcgtgaagcctggcggctctctgaagctgagctgtgccgccagcggcttcaccttcagcagctacggcatgagctgggtgcgccagacccccgacaagagactggaatgggtggcaaccatcagcagcggcggcagctacacctactaccccgatagcgtgaagggccggttcaccatctccagagacaacgccaagaacaccctgtacctccagatgagcagcctgaagtccgaggataccgccatgtactactgcgccagaggcaactgggagggctggtacttcgatgtgtggggccagggcaccaccgtgaccgtgtcatct

SEQ ID NO: 301 - DNA, 345 bp, Artificial Sequence
  Heavy Chain Variable Fragment (vH)
caggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgct

SEQ ID NO: 302 - DNA, 357 bp, Artificial Sequence
  Heavy Chain Variable Fragment (vH)
caggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagt

SEQ ID NO: 303 - DNA, 348 bp, Artificial Sequence
  Heavy Chain Variable Fragment (vH)
gaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtg

SEQ ID NO: 304 - DNA, 351 bp, Artificial Sequence
  Heavy Chain Variable Fragment (vH)
gaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttct

SEQ ID NO: 305 - DNA, 360 bp, Artificial Sequence
  Heavy Chain Variable Fragment (vH)
gaagtgcaactggtggaatctggcggcggactggtgcagcctggcggatctctgagactgagctgtgccgccagcggcttcaacatcaaggacacctacatccactgggtgcgccaggcccctggaaagggactggaatgggtggcccggatctaccccaccaacggctacaccagatacgccgacagcgtgaagggccggttcaccatcagcgccgacaccagcaagaataccgcctacctccagatgaacagcctgcgggccgaggataccgccgtgtactactgctcaagatggggaggcgacggcttctacgctatggacgtgtggggccagggcacccttgtgaccgtgtcatct

SEQ ID NO: 306 - DNA, 387 bp, Artificial Sequence
  Heavy Chain Variable Fragment (vH)
caggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggaccc

SEQ ID NO: 307 - DNA, 354 bp, Artificial Sequence
  Heavy Chain Variable Fragment (vH)
gaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctct

SEQ ID NO: 308 - DNA, 405 bp, Artificial Sequence
  Heavy Chain Variable Fragment (vH)
cagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagc

SEQ ID NO: 309 - DNA, 363 bp, Artificial Sequence
  Heavy Chain Variable Fragment (vH)
caggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagc

SEQ ID NO: 310 - DNA, 384 bp, Artificial Sequence
  Heavy Chain Variable Fragment (vH)
ctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctca

SEQ ID NO: 311 - DNA, 366 bp, Artificial Sequence
  Heavy Chain Variable Fragment (vH)
gaagtgcaggtggaagtgtctggcggcggactggtgcagcctggcggatctatgagactgagctgtgccgtgtccggcttcaccttcagcaactactggatgaactgggtgcgccagtcccccgagaagggcctggaatggatcgccgagatccggctgaagtccaacaacttcgcccggtactacgccgagagcgtgaagggcagattcaccatcagccgggacaacagcaagaacagcctgtacctccagatgatctccctgagagccgaggacaccgccatctactactgcaccagctacggcaactacgtgggccactacttcgaccactggggccagggaacactgctgaccgtgtctagc

SEQ ID NO: 312 - DNA, 366 bp, Artificial Sequence
  Heavy Chain Variable Fragment (vH)
gaagtgcagctggtgcagtctggcgctgaggtgtccgtgaaggtgtcctgcaaagccagcggcggcaagaagcccggcagcacctttagcagctacaccatcagctgggtgcgccaggcacctggacagggcctggaatggatgggcggcatcatccccatcttcggcaccgccaactacgcccagaaattccagggcagagtgaccatcaccgccgacaagagcaccagcaccgcctacatggaactgagcagcctgcggagcgaggacacagccgtgtattattgtgccggcgacaccgacagcagcggctactatggcgctgtggactattggggccagggaaccctcgtgaccgtgtcctct

SEQ ID NO: 313 - DNA, 372 bp, Artificial Sequence
  Heavy Chain Variable Fragment (vH)
caggtgcaactggtgcagtctggcggcggagtggtgcagcctggaagaagcctgagactgagctgtgccgccagcggcttcaccttcagcagctacggaatgcactgggtgcgccaggcccctggcaaaggactggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgcgccagagacttcgactacggcgacagctactactactatggcatggacgtgtggggccagggcacaaccgtgaccgtgtcatct

SEQ ID NO: 314 - DNA, 354 bp, Artificial Sequence
  Heavy Chain Variable Fragment (vH)
gaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagc

SEQ ID NO: 315 - DNA, 348 bp, Artificial Sequence
  Heavy Chain Variable Fragment (vH)
gaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctct

SEQ ID NO: 316 - DNA, 366 bp, Artificial Sequence
  Heavy Chain Variable Fragment (vH)
gaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatct

SEQ ID NO: 317 - DNA, 357 bp, Artificial Sequence
  Heavy Chain Variable Fragment (vH)
caggtgcagctccaggagagtggcccaggacttgtgaagccaagtgaaactctctcactcacttgtgctgtgagtggatacagtatcagtgacgatcacgctgtcagctgggtacgacaacctcccggagagggtctggagtggatcggtttcatttcctatagtggcattacaaactacaaccccacacttcaggaccgcgtcacaatttcacgggacaattccaagaacaccctgtatctccagatgaatagtctgagggcagaggatacggctgtgtactactgtgcccggctgctcgcccgcgcaacagctatggacgtgtggggtgaggggaccctggtgaccgtaagttcc

SEQ ID NO: 318 - DNA, 384 bp, Artificial Sequence
  Heavy Chain Variable Fragment (vH)
caagttcagctccagcagtctggccctggcctggttaagcctagccagacactgagcctgacctgtgccatcagcggcgatagcgtgtccagctacaacgccgtgtggaactggatcagacagagcccatccagaggactggaatggctgggcagaacctactacagaagcggctggtacaacgactacgccgagagcgtgaagtcccggatcaccatcaatcccgacaccagcaagaaccagttcagcctgcaactgaacagcgtgacccctgaggataccgccgtgtactactgtgctagaagcggccacatcaccgtgttcggcgtgaacgtggacgccttcgatatgtggggccagggaacaatggtcaccgtgtctagt

SEQ ID NO: 319 - DNA, 363 bp, Artificial Sequence
  Heavy Chain Variable Fragment (vH)
gaggttcagctccagcagtctgggactgtgctggcaaggcctgggacttccgtgaagatgtcctgcagggcttctggctacagctttaccaccttctggatgcactgggtaaaacagaggcctggacagggtccagaatggattggtgctatttatcctgaaaatagtgatactaggtacaacccgactttcaaggacaaggccgaactgactgcagtcacatccgccaacactgtctacatggaactcagcagcctgacagatgaggactctgcggtctattactgtacaagaccgtccctctatgctatggactactggggtcaaggaacctcagtcaccgtctcctcagccaaaacaaca

SEQ ID NO: 320 - DNA, 366 bp, Artificial Sequence
  Heavy Chain Variable Fragment (vH)
cagatccagctggtgcagagcggccctgacctgaagaaacccggcgagacagtgaagatcagttgcaaggcctccggctacaccttcaccaacacaggcatgaactgggtcaagcaggcccctggcaagggcctgaagtggatgggctggatcaacacctacaccggcgagcccacctacgccgacgacttcaagggccggttcaccttcagcctggaaaccagcgccagcaccgcctacctgcagatcaacaacctgaagaacgaggacaccgccacctatttctgcaccagatggggctacggcagcagcctgtactacgccatggactactggggccagggcaccagcgtgaccgtgtcctct

SEQ ID NO: 321 - DNA, 351 bp, Artificial Sequence
  Heavy Chain Variable Fragment (vH)
gaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctct

SEQ ID NO: 322 - DNA, 354 bp, Artificial Sequence
  Heavy Chain Variable Fragment (vH)
caggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctct

SEQ ID NO: 323 - DNA, 357 bp, Artificial Sequence
  Heavy Chain Variable Fragment (vH)
caggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatct

SEQ ID NO: 324 - DNA, 354 bp, Artificial Sequence
  Heavy Chain Variable Fragment (vH)
gaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagt

SEQ ID NO: 325 - DNA, 357 bp, Artificial Sequence
  Heavy Chain Variable Fragment (vH)
caggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagcc

SEQ ID NO: 326 - DNA, 381 bp, Artificial Sequence
  Heavy Chain Variable Fragment (vH)
gaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctca

SEQ ID NO: 327 - DNA, 360 bp, Artificial Sequence
  Heavy Chain Variable Fragment (vH)
gaagtgcaactccagcagagcggagccgaagtgaagaaacccggcagctccgtgaaggtgtcctgcaaggcttccggcggcaccttcagcagctacgccatttcttgggtgcgccaggcccctggacagggcctggaatggatgggcagaatcatccccatcctgggaatcgccaactacgcccagaaattccagggccgcgtgaccatcaccgccgacaagagcacaagcaccgcctacatggaactgagcagcctgcggagcgaggacaccgccgtgtactactgcgccagagatgtgggcagcggctcctacagcctggactattggggccagggcaccctcgtgaccgtgtctagt

SEQ ID NO: 328 - DNA, 354 bp, Artificial Sequence
  Heavy Chain Variable Fragment (vH)
caactccaactccaggaaagcggccctggcctcgtgaagcctagcgagacactgagcctgacctgcaccgtgtctggcggcagcatctccagcagctcctactactggggctggatcagacagccccctggcaagggcctggaatggatcggctccatctactacagcggaagcacctactacaaccccagcctgaagtcccgcgtgaccatcagcgtggacaccagcaagaaccagttctccctgaagctgagcagcgtgacagccgccgataccgccgtgtactactgtgccagacatgtgggccacgagctggattactggggccagggcacactcgtgaccgtgtctagt

SEQ ID NO: 329 - DNA, 357 bp, Artificial Sequence
  Heavy Chain Variable Fragment (vH)
caggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgatatctggggccagggcacaatggtcaccgtgtcctct

SEQ ID NO: 330 - DNA, 357 bp, Artificial Sequence
  Heavy Chain Variable Fragment (vH)
caggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctct

SEQ ID NO: 331 - DNA, 354 bp, Artificial Sequence
  Heavy Chain Variable Fragment (vH)
gatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctct

SEQ ID NO: 332 - DNA, 354 bp, Artificial Sequence
  Heavy Chain Variable Fragment (vH)
gatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagc

SEQ ID NO: 333 - DNA, 354 bp, Artificial Sequence
  Heavy Chain Variable Fragment (vH)
gacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagc

SEQ ID NO: 334 - DNA, 360 bp, Artificial Sequence
  Heavy Chain Variable Fragment (vH)
gaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctct

SEQ ID NO: 335 - DNA, 345 bp, Artificial Sequence
  Heavy Chain Variable Fragment (vH)
caggttcaactgcagcagtctggacctgaactggtgaagcctggggcctcagtgaagatgtcctgcaaggcttctggctacgcattcagtagttcctggttgaactgggtgaggcagaggcctggaaagggtcttgagtggattggacggatttatcctggagatggagaaaatcactataatgggaaattcaagggcaaggccacactgactgcagacaaatcctccagcacaggctacatgcaactcagcagcctgacgtctgaggactctgcggtctacttctgtgcaagttattatgaagggggttattggggccaagggactctaatcactgtctctgca

SEQ ID NO: 336 - DNA, 354 bp, Artificial Sequence
  Heavy Chain Variable Fragment (vH)
caggtccagctcgtccagtctggacccgaagtcaagaagccaggcgcctctgtgaaggtttcttgtaaggccagcggatatacattcactaattcatggatgaactgggtgaggcagcgccctggcaaggggcttgagtggatcgggcggatttacccaggggatggcgagacaatttacaacgggaaatttcgggtgagagtgacgatcaccgcagacgaatctacaagcacggcctacatggagttgtcctctctcaggagtgaggacaccgccgtctactattgtgctagaggttatgacgactattcattcgcatactggggccagggcaccaccgtcacagtatcatct

SEQ ID NO: 337 - DNA, 339 bp, Artificial Sequence
  Heavy Chain Variable Fragment (vH)
caggtgcagctgcagcagtcgggcccaggactggtgaagccttcggagaccctgtccctcacctgcactgtctctggtgactccatcagtagttactactggagctggatcaggcagcccccagggaagggactggagtggattgggtatatctattacagtgggagcaccaactacaacccctccctcaagagtcgagtcaccatatcagtagacacgtccaagagccagttctccctgaagctgagctctgtgaccgccgcagacacggccgtgtattactgtgcgcgcggcaggtacttcgatgtctggggacgaggcactatggtgactagcagc

SEQ ID NO: 338 - DNA, 345 bp, Artificial Sequence
  Heavy Chain Variable Fragment (vH)
gaggtcaagctggtagagagtggaggtgggctggttaaaccaggggggagcagaaaactgagttgtgccgcaagtggcttcaccttttctagctataccatgagctgggtaagacaaactccagcaaagcgccttgagtgggtcgcaacaattagcagcggatcttctactatttattacgctgacactgttaagggccggtttaccatatcaagagacaacgccaagaatacccttttccttcaaatgacttcactgcggtccgaggatacggcaatgtactattgtgcacgacggtggtttctcgactgctggggccaggggactacccttaccgtgtctagt

SEQ ID NO: 339 - DNA, 369 bp, Artificial Sequence
  Heavy Chain Variable Fragment (vH)
gaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagc

SEQ ID NO: 340 - DNA, 363 bp, Artificial Sequence
  Heavy Chain Variable Fragment (vH)
gaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatct

SEQ ID NO: 341 - DNA, 366 bp, Artificial Sequence
  Heavy Chain Variable Fragment (vH)
gtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagt

SEQ ID NO: 342 - DNA, 345 bp, Artificial Sequence
  Heavy Chain Variable Fragment (vH)
caagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagc

SEQ ID NO: 343 - DNA, 342 bp, Artificial Sequence
  Heavy Chain Variable Fragment (vH)
gtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctct

SEQ ID NO: 344 - DNA, 354 bp, Artificial Sequence
  Heavy Chain Variable Fragment (vH)
gtgcagctgctggaatctggcggcggactggtgcagcctggcggatctctgagactgagctgtgccgcctccggcttcaccttcagcacctaccagatgagctgggtgcgccaggcccctggcaaaggactggaatgggtgtccgggatcgtgtccagcggcggctctacagcctacgccgatagcgtgaagggccggttcaccatcagccgggacaacagcaagaacaccctgtacctgcagatgaacagcctgagagccgaggacaccgccgtgtactattgtgccggcgagctgctgccctactacggcatggatgtgtggggccagggcaccaccgtgaccgtgtcatct

SEQ ID NO: 345 - DNA, 357 bp, Artificial Sequence
  Heavy Chain Variable Fragment (vH)
gaagtgcagctgctggaatctggcggcggactggtgcagcctggcggatctctgagactgagctgtgccgccagcggcttcaccttcagcacctacgagatgcactgggtgcgccaggcccctggcaaaggactggaatgggtgtccgtgatcctgagcagcggcggagagacaaactacgccgacagcgtgaagggccggttcaccatcagccgggacaacagcaagaacaccctgtacctccagatgaacagcctgcgggccgaggacaccgccgtgtactattgtgccggaatgctgctgccctactacggcatggatgtgtggggccagggcaccaccgtgaccgtgtcatct

SEQ ID NO: 346 - DNA, 339 bp, Artificial Sequence
  Heavy Chain Variable Fragment (vH)
caggtgtacctggtggaaagcggagggggcgtggtgcagcctggaagaagcctgagactgagctgtgccgccagcggcttcaccttcagcaactacggaatgcactgggtgcgccaggcccctggcaaaggactggaatgggtggccctgatttggtacgacggcagcaacaagtattacgccgacagcgtgaagggccggttcaccatcagccgggacaacagcaagaacaccctgtacctccagatgaccagcctgcgggtggaagataccgccgtgtattattgcgccagcaacgtggaccactggggccagggaacactcgtgaccgtgtctagc

SEQ ID NO: 347 - DNA, 330 bp, Artificial Sequence
  Heavy Chain Variable Fragment (vH)
caggtgcagctggtggaaagtgggggaggatggcagcctggcagaagcctgagactggactgcaaggccagcggcatcaccttcagcaacagcggaatgcactgggtgcgccaggcccctggaaagggactggaatgggtggccgtgatctatgacggcagcaagcggtactacgccgacagcgtgaagggccggttcatcagccgggacaacagcaagaataccctgttcctccagatgaacagcctgcgggccgaggacacagccgtgtattattgcgccaccaacgacgactactggggccagggaacactcgtgaccgtgtcctct

SEQ ID NO: 348 - DNA, 354 bp, Artificial Sequence
  Heavy Chain Variable Fragment (vH)
gaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatct

SEQ ID NO: 349 - DNA, 345 bp, Artificial Sequence
  Heavy Chain Variable Fragment (vH)
caatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagt

SEQ ID NO: 350 - DNA, 321 bp, Artificial Sequence
  Heavy Chain Variable Fragment (vH)
gaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttct

SEQ ID NO: 351 - DNA, 402 bp, Artificial Sequence
  Heavy Chain Variable Fragment (vH)
gtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatct

SEQ ID NO: 352 - DNA, 390 bp, Artificial Sequence
  Heavy Chain Variable Fragment (vH)
ggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagt

SEQ ID NO: 353 - DNA, 369 bp, Artificial Sequence
  Heavy Chain Variable Fragment (vH)
caggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatct

SEQ ID NO: 354 - DNA, 345 bp, Artificial Sequence
  Heavy Chain Variable Fragment (vH)
gaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagt

SEQ ID NO: 355 - DNA, 360 bp, Artificial Sequence
  Heavy Chain Variable Fragment (vH)
cagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatct

SEQ ID NO: 356 - DNA, 345 bp, Artificial Sequence
  Heavy Chain Variable Fragment (vH)
caggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgct

SEQ ID NO: 357 - DNA, 357 bp, Artificial Sequence
  Heavy Chain Variable Fragment (vH)
gaagtgaagctggtggaatcaggaggaggcctcgtgaaacctggcggctctctgaagctgagctgtgccgccagcggcttcaccttcagcagctacgccatgagctgggtgcgccagattcccgagaagcggctggaatgggtggcctccattagcagaggcggcaccacctactaccccgacagcgtgaagggccggttcaccatctccagagacaacgtgcggaacatcctgtacctccagatgagcagcctgcggagcgaggacaccgccatgtactactgcggcagatacgactacgacggctactacgctatggactactggggccagggcaccagcgtgaccgtgtcatct

SEQ ID NO: 358 - DNA, 360 bp, Artificial Sequence
  Heavy Chain Variable Fragment (vH)
gaagtgaagctccaggaaagcggccctgagctcgtgaagcctggcgcctctgtgaagatgagctgcaaggccagcggctacaccttcaccagctacgtgatgcactgggtcaagcagaagcccggccagggcctggaatggatcggctacatcaacccctacaacgacggcaccaagtacaacgagaagttcaagggcaaggccaccctgaccagcgacaagagcagcagcaccgcctacatggaactgagcagcctgacctccgaggacagcgccgtgtactactgcgcccggtggaaaatctactacggcaactacgaggactactggggccagggcacacccctgacagtgtctagt

SEQ ID NO: 359 - DNA, 369 bp, Artificial Sequence
  Heavy Chain Variable Fragment (vH)
caggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagt

SEQ ID NO: 360 - DNA, 378 bp, Artificial Sequence
  Heavy Chain Variable Fragment (vH)
caggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagt

SEQ ID NO: 361 - DNA, 357 bp, Artificial Sequence
  Heavy Chain Variable Fragment (vH)
caggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttct

SEQ ID NO: 362 - DNA, 360 bp, Artificial Sequence
  Heavy Chain Variable Fragment (vH)
caggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatct

SEQ ID NO: 363 - DNA, 372 bp, Artificial Sequence
  Heavy Chain Variable Fragment (vH)
gaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctct

SEQ ID NO: 364 - DNA, 357 bp, Artificial Sequence
  Heavy Chain Variable Fragment (vH)
caggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctct

SEQ ID NO: 365 - DNA, 354 bp, Artificial Sequence
  Heavy Chain Variable Fragment (vH)
gaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctct

SEQ ID NO: 366 - DNA, 357 bp, Artificial Sequence
  Heavy Chain Variable Fragment (vH)
gaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgct

SEQ ID NO: 367 - DNA, 369 bp, Artificial Sequence
  Heavy Chain Variable Fragment (vH)
caggtgcaactggtgcagtctggcggcggagtggtgcagcctggaagaagcctgagactgtcctgtgccgccagcggcttcaccttcagcagctacgccatgcactgggtgcgccaggcccctggaaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacacagccgtgtattattgcgccagagagctgcggttcctggaatggtccagcgacgccttcgacatctggggccagggaacaatggtcaccgtgtcctcc

SEQ ID NO: 368 - DNA, 357 bp, Artificial Sequence
  Heavy Chain Variable Fragment (vH)
caggtgcagctggtgcagtctggggccgaagtgaagaaacccggcagcagcgtgaaggtgtcctgcaaggcttccggcggcaccttcagcagctacgccatttcttgggtgcgccaggccccaggacagggcctggaatggatgggctggatcaacgtgggcaacggcaacgccatctacagccagaaattccagggccgcgtgacaatcaccagagacaccagcgccaccaccgcctacatggaactgagcagcctgcggagcgaggacaccgccgtgtactactgtgccagggatggcgagagagcctgggacctggattattggggccagggcacactcgtgaccgtgtcctct

SEQ ID NO: 369 - DNA, 363 bp, Artificial Sequence
  Heavy Chain Variable Fragment (vH)
caactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctct

SEQ ID NO: 370 - DNA, 369 bp, Artificial Sequence
  Heavy Chain Variable Fragment (vH)
caggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctct

SEQ ID NO: 371 - DNA, 360 bp, Artificial Sequence
  Heavy Chain Variable Fragment (vH)
caggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatct

SEQ ID NO: 372 - DNA, 348 bp, Artificial Sequence
  Heavy Chain Variable Fragment (vH)
caggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagt

SEQ ID NO: 373 - DNA, 348 bp, Artificial Sequence
  Heavy Chain Variable Fragment (vH)
caggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagc

SEQ ID NO: 374 - DNA, 363 bp, Artificial Sequence
  Heavy Chain Variable Fragment (vH)
cagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatct

SEQ ID NO: 375 - DNA, 357 bp, Artificial Sequence
  Heavy Chain Variable Fragment (vH)
caggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctct

SEQ ID NO: 376 - DNA, 378 bp, Artificial Sequence
  Heavy Chain Variable Fragment (vH)
gaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagt

SEQ ID NO: 377 - DNA, 357 bp, Artificial Sequence
  Heavy Chain Variable Fragment (vH)
caggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctct

SEQ ID NO: 378 - DNA, 351 bp, Artificial Sequence
  Heavy Chain Variable Fragment (vH)
gaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctct

SEQ ID NO: 379 - DNA, 366 bp, Artificial Sequence
  Heavy Chain Variable Fragment (vH)
caggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagc

SEQ ID NO: 380 - DNA, 363 bp, Artificial Sequence
  Heavy Chain Variable Fragment (vH)
gaagtgcaactggtggaaagcggaggcggcgtggtgcagcctggaagaagcctgagactgagctgtgccgccagcggcttcaccttccggtcctacggaatgcactgggtgcgccaggcccctggcaaaggactggaatgggtggccgtgatctcctacgacggctccaacaagtactacaccgacagcgtgaacggcagattcaccatcagcagagacaacagcaagaacaccctgtacctccagatgaacagcctgcgggccgaggacaccgccgtgtactattgtgctagaggcggaggctactacgagacaagcggccctgattactggggccagggcacactcgtgaccgtgtctagt

SEQ ID NO: 381 - DNA, 357 bp, Artificial Sequence
  Heavy Chain Variable Fragment (vH)
caactccaactccaggaaagcggccctggcctcgtgaagcctagcggcacactgagcctgacatgtgccgtgtctggcggcagcatcagcagcagcaactggtggtcttgggtgcgccagcctcctggcaagggcctggaatggatcggcgaaatctaccacagcggcagcaccaactacaaccccagcctgaagtccagagtgaccatcagcgtggacaagagcaagaaccagttctccctgaagctgagcagcgtgacagccgccgataccgccgtgtactattgcgtgggcagcccctacggcgactacgtgctggattattggggccagggcaccctcgtgaccgtgtctagt

SEQ ID NO: 382 - DNA, 369 bp, Artificial Sequence
  Heavy Chain Variable Fragment (vH)
gaagtgcagctggtggaaacaggcggaggcgtggtgcagcctggcagaagcctgagactgagctgtgccgccagcggcttcaccttcagcagctacggaatgcactgggtgcgccaggcccctggcaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacaccgccgtgtactattgcgccaaggacagatacggctggggcagcagcttcggccacttcgattattggggccagggcaccctcgtgaccgtgtctagt

SEQ ID NO: 383 - DNA, 369 bp, Artificial Sequence
  Heavy Chain Variable Fragment (vH)
caggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagt

SEQ ID NO: 384 - DNA, 363 bp, Artificial Sequence
  Heavy Chain Variable Fragment (vH)
cagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagc

SEQ ID NO: 385 - DNA, 354 bp, Artificial Sequence
  Heavy Chain Variable Fragment (vH)
caggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagt

SEQ ID NO: 386 - DNA, 357 bp, Artificial Sequence
  Heavy Chain Variable Fragment (vH)
caggtgcaactggtgcagtctggggccgaagtgaagaaacccggcagctccgtgaaggtgtcctgcaaggcttccggcggcaccttcagcagctacgccatttcttgggtgcgccaggcccctggacagggcctggaatggatgggcggcatcatccccatctttggcaccgccaactacgcccagaaattccagggccgcgtgaccatcaccgccgacgagtctacaagcaccgcctacatggaactgagcagcctgcggagcgaggataccgccgtgtactactgtgccagaagaatccccccctactacggcatggacgtgtggggccagggaaccaccgtgaccgtgtcatct

SEQ ID NO: 387 - DNA, 363 bp, Artificial Sequence
  Heavy Chain Variable Fragment (vH)
gaagtgcaactggtgcagtctggcggaggggtcatgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgttaccgtgtcctct

SEQ ID NO: 388 - DNA, 363 bp, Artificial Sequence
  Heavy Chain Variable Fragment (vH)
gaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctct

SEQ ID NO: 389 - DNA, 360 bp, Artificial Sequence
  Heavy Chain Variable Fragment (vH)
gacgtgcagctggtggagagcggcggcggcctggtgcagcccggcggcagcagaaagctgagctgcgccgccagcggcttcaccttcagcagcttcgggatgcactgggtgagacaggcccccgagaagggcctggagtgggtggcctacatcagcagcggcagcagcaccctgcactacgccgacaccgtgaagggcagattcaccatcagcagagacaaccccaagaacaccctgttcctgcagatgaccagcctgagaagcgaggacaccgccatgtactactgcgccagatggggcaactacccccactacgctatggactactggggccagggcaccagcgtgaccgtgagcagc

SEQ ID NO: 390 - DNA, 354 bp, Artificial Sequence
  Heavy Chain Variable Fragment (vH)
cagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttct

SEQ ID NO: 391 - DNA, 357 bp, Artificial Sequence
  Heavy Chain Variable Fragment (vH)
caggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagt

SEQ ID NO: 392 - DNA, 354 bp, Artificial Sequence
  Heavy Chain Variable Fragment (vH)
gaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctct

SEQ ID NO: 393 - DNA, 363 bp, Artificial Sequence
  Heavy Chain Variable Fragment (vH)
caagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttct

SEQ ID NO: 394 - DNA, 339 bp, Artificial Sequence
  Heavy Chain Variable Fragment (vH)
gaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatct

SEQ ID NO: 395 - DNA, 348 bp, Artificial Sequence
  Heavy Chain Variable Fragment (vH)
gaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatct

SEQ ID NO: 396 - DNA, 363 bp, Artificial Sequence
  Heavy Chain Variable Fragment (vH)
gaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttct

SEQ ID NO: 397 - DNA, 363 bp, Artificial Sequence
  Heavy Chain Variable Fragment (vH)
gaagtgcaactggttgaatctggcggcggactggttcagcctggcggatctctgagactgagctgtgccgtgtctggctacagcatcaccagcggctactcttggaactggatcagacaggcccctggcaaaggactggaatgggtcgcctccatcacctacgatggcagcaccaactacaaccccagcgtgaagggcagaatcaccatcagcagggacgacagcaagaacaccttctacctgcaaatgaacagcctgagagccgaggacaccgccgtgtactattgtgccagaggcagccactacttcggccactggcattttgctgtgtggggccagggaaccctggtcacagtttcttct

SEQ ID NO: 398 - DNA, 354 bp, Artificial Sequence
  Heavy Chain Variable Fragment (vH)
gaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatct

SEQ ID NO: 399-420 - skipped (22 entries)

SEQ ID NO: 421 - DNA, 372 bp, Artificial Sequence
  vHH domain
gaagtgcaactggtggaatctggaggctctctggtgcagccagggggaagcctgagactgtcttgtgccgcttccggcttcaccttcgacgactacgccatgagctgggtgcgccaggtgccaggcaaaggcctggaatgggtgtccagcatcaactggagcggcacccacaccgattacgccgactccgtgaaaggcagattcacaatcagcagaaacaacgccaacaataccctgtacctgcagatgaactccctgaagtctgaggatacagcagtgtattattgcgccaagaactggcgggacgccggcaccacttggtttgagaaaagcggctctgccggacagggaacccaagtgacagtgtcctcc

SEQ ID NO: 422 - DNA, 354 bp, Artificial Sequence
  vHH domain
gaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctct

SEQ ID NO: 423 - DNA, 357 bp, Artificial Sequence
  vHH domain
gaagtgcaactggtggaatctgggggcggactggtgcagccaggcggaagtctgaggctgtcttgtgccgcctccggcagcatcttcggcttcaacgacatggcctggtatcggcaggctcccggaaaacagcgcgagctggtggctctgattagcagagtgggcgtgaccagcagcgccgactctgtgaagggcagattcacaatctccagagtgaacgccaaggatacagtgtacctccagatgaactctctgaaacctgaggatacagcagtgtactattgctacatggaccagcggctggacggcagcacactggcctactggggacagggaactcaagtgacagtgtctagc

SEQ ID NO: 424 - DNA, 360 bp, Artificial Sequence
  vHH domain
gacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtctcgag

SEQ ID NO: 425 - DNA, 375 bp, Artificial Sequence
  vHH domain
gaagtgcaactggtggagtccggcggtggactggtacagcctgggggttcactgcgcctgtcctgcgccgccagcggaagaacctattacctcaatgctatgggttggttccgccaggccccaggaaaggagcgcgagttcgtggcggctattgactggtccgaggggaacaaggactatgctgattccgtgaagggcaggtttaccatcagccgggataattcaaaaaatactgtttatttgcagatgaactctcttagaccagaagacactgctgtctattactgcgccgctgacacccctccttggggaccactgatttatatcgaaagctatgattcctgggggcagggcacactcgtcaccgtgagtagc

SEQ ID NO: 426 - DNA, 369 bp, Artificial Sequence
  vHH domain
gaggtgcaactggtggaatccgggggaggcagcgtgcaggctgggggatcactgagactgtcttgtgctgcctccggcgacacctacggcagctattggatgggatggtttcggcaggctcccggaaaagaacgggaaggcgtggccgccatcaacagaggcggcggatacaccgtgtacgccgactctgtgaagggcagattcacaatctccagagacacagccaagaatactgtgtacctgcagatgaactccctgcgccccgacgataccgccgactattattgcgccgcttccggcgtgctgggcggcctgcatgaggactggttcaattattggggacagggaacacttgtgacagtgtccagc

SEQ ID NO: 427 - DNA, 366 bp, Artificial Sequence
  vHH domain
gttcagctcgtggaaagcggtggcggaagtgtgcaggccggaggcagtttgcgcctgagctgcgctgcttccggcgatacatacgggtcttactggatgggctggtttaggcaggcacctggacaagaaagagaagctgtggccgctattaacaggggaggtggctataccgtttatgctgattccgtgaagggccgattcacaatctcccgggataacgccaaaaacactctgtacctgcagatgaactcccttaggcccgatgacacagccgattactattgtgcggcctccggcgtgctgggtggtctgcatgaggattggttcaactactgggggcaaggcaccctcgtaaccgtgagtagc

SEQ ID NO: 428 - DNA, 372 bp, Artificial Sequence
  vHH domain
gaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatct

SEQ ID NO: 429 - DNA, 372 bp, Artificial Sequence
  vHH domain
gaggtgcagctcgtagaatctggaggtggttccgtgcaagccggaggatcattgcgactgacctgcgcagcgagcggatctacttctcgctcttacggtatgggatggttcagacaggctcctgggaaagagcgcgagttcgtttcaggcatctcctggaggggggacagcaccggctacgcagatagcgtgaagggcaggttcacgatcagccgagacaacgccaaaaacaccgtcgatctgcaaatgaatagtctgaagcccgaagatactgcgatctactactgtgccgccgcagcagggtccacctggtacggcacactctacgagtacgactactgggggcagggaaccctggtaaccgtgtcctct

SEQ ID NO: 430 - DNA, 375 bp, Artificial Sequence
  vHH domain
gatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagc

SEQ ID NO: 431 - DNA, 378 bp, Artificial Sequence
  vHH domain
gaggtgcaactggtggaaagcggcggaggactggtgcaggctggcgatagcctgagactgagctgtgccgcctccggcagagccttcagcagatatgccatgggctggttcagacaggcccctggcaaagaacgcgagttcgtggccgccatcggctggggacctagcaagaccaactacgccgacagcgtgaagggccggttcaccatcagccgggacaacgccaagaacaccgtgtacctgcagatgaacaccctgaagcccgaggacaccgccgtgtactcttgcgccgccaagttcgtgaacaccgacagcacctggtcccgcagcgagatgtacacctattggggccagggcaccctcgtgaccgtgtctagt

SEQ ID NO: 432 - DNA, 366 bp, Artificial Sequence
  vHH domain
gaggtgcagctggtagaatccggcgggggacttgtacaggctggtggtagtctgagactgagctgtgtggcctccggcatcagcagcagcaagcggaacatgggatggtataggcaagcccctggtaagcagagggaatccgtggctacaatcagcagcggcggcaacaaggactacaccgacgccgtgaaggacaggttcaccatctccagggacaccaccaagaacaccgtgtacctgcagatgaactccctcaagcccgaggacaccgccgtgtactactgcaagatcgaggccggcacaggctgggccaccagaagaggctacacatactgggggcagggaacactggtgaccgtgagctcc

SEQ ID NO: 433 - DNA, 336 bp, Artificial Sequence
  vHH domain
caggtgcaactggtgcagtctggcggagggctggtgcagccagggggatctctgagactgagctgtgccgccagcgacttcgacttcgccgcctacgagatgagctgggtgcgccaggctcctggacagggactggaatgggtggccatcatcagccacgacggcatcgacaagtattacaccgacagcgtgaagggccggttcaccatcagccgggacaacagcaagaacaccctgtacctgcagatgaataccctgcgggccgaggacaccgccacctactattgcctgagactgggagccgtgggccagggcacacttgtgacagtgtctagc

SEQ ID NO: 434 - DNA, 360 bp, Artificial Sequence
  vHH domain
caggtgcaactggtgcagagcggaggcggactggtgcagcctgggggcagtctgaggctgtcttgtgccgcctccgatttcgccttcgatgattacgagatgtcttgggtgcggcaggccccaggcaaagccctggaatggatcggcgacatcaaccacagcggcaccaccatctacaaccccagcctgaagtccagagtgaccatctccagagacaactccaagaatactctgtacctgcagatgaacacactgagagccgaagatacagccatctactactgcgccagaccccactacggcgactacagcgacgccttcgacatctggggccagggaaccatggtcaccgtgtcctct

SEQ ID NO: 435 - DNA, 345 bp, Artificial Sequence
  vHH domain
gaggtgcagctcgtggaatcaggcggaggtcttgtacagccaggaaattctcttcggctgtcttgcgccgcgagcgggttcaccttcagcagcttcggaatgagctgggtaagacaggcaccggggaaaggcctggagtgggtgagctcaatcagtgggagcgggtcagataccctgtacgcggattccgtgaagggcagattcacaatctctcgggacaatgctaagacaacactttaccttcagatgaactctctgcgacccgaggataccgctgtctactactgtacaataggaggttctctgtccagaagttctcaagggacactggtgaccgtctccagc

SEQ ID NO: 436 - DNA, 348 bp, Artificial Sequence
  vHH domain
gaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttcc

SEQ ID NO: 437 - DNA, 378 bp, Artificial Sequence
  vHH domain
gaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagc

SEQ ID NO: 438 - DNA, 363 bp, Artificial Sequence
  vHH domain
gaggttcagttggtcgaatcaggcgggggcctcgtccaacccggcggaagcctgcggctgtcttgcgcagcaagtggtagtgtgttcaagatcaacgttatggcctggtatcgccaggctccgggaaaagggagagagctggttgcggggatcattagcggtggctccaccagctacgctgacagtgtgaagggaaggttcactatatcacgcgacaacgcaaagaatacattgtacctccagatgaatagcttgcggcccgaagacacggcagtctactattgtgcctttatcacaacagagagcgactatgacctgggccgccggtattgggggcagggaacccttgtgaccgtttcatcc

SEQ ID NO: 439 - DNA, 798 bp, Artificial Sequence
  vHH domain
gaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgagggcggaggcggaagtggaggcggaggatctggcggcggaggctctttcgaagaggtgcaactggtggaatccgggggaggcagcgtgcaggctgggggatcactgagactgtcttgtgctgcctccggcgacacctacggcagctattggatgggatggtttcggcaggctcccggaaaagaacgggaaggcgtggccgccatcaacagaggcggcggatacaccgtgtacgccgactctgtgaagggcagattcacaatctccagagacacagccaagaatactgtgtacctgcagatgaactccctgcgccccgacgataccgccgactattattgcgccgcttccggcgtgctgggcggcctgcatgaggactggttcaattattggggacagggaacacttgtgacagtgtccagc

SEQ ID NO: 440 - DNA, 855 bp, Artificial Sequence
  vHH domain
gaggtgcagctcgtagaatctggaggtggttccgtgcaagccggaggatcattgcgactgacctgcgcagcgagcggatctacttctcgctcttacggtatgggatggttcagacaggctcctgggaaagagcgcgagttcgtttcaggcatctcctggaggggggacagcaccggctacgcagatagcgtgaagggcaggttcacgatcagccgagacaacgccaaaaacaccgtcgatctgcaaatgaatagtctgaagcccgaagatactgcgatctactactgtgccgccgcagcagggtccacctggtacggcacactctacgagtacgactactgggggcagggaaccctggtaaccgtgtcctctctcgagggaggaggcggctccgggggaggcggaagtggaggcggaggatctgggtctggaggaagcggatctggaggctcagggtcagggggctcaggcagtggaggctctttcgaagttcagctcgtggaaagcggtggcggaagtgtgcaggccggaggcagtttgcgcctgagctgcgctgcttccggcgatacatacgggtcttactggatgggctggtttaggcaggcacctggacaagaaagagaagctgtggccgctattaacaggggaggtggctataccgtttatgctgattccgtgaagggccgattcacaatctcccgggataacgccaaaaacactctgtacctgcagatgaactcccttaggcccgatgacacagccgattactattgtgcggcctccggcgtgctgggtggtctgcatgaggattggttcaactactgggggcaaggcaccctcgtaaccgtgagtagc

SEQ ID NO: 441 - DNA, 825 bp, Artificial Sequence
  vHH domain
gaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctctcgagggaggaggcggctccgggggaggcggaagtggaggcggaggatctgggtctggaggaagcggatctggaggctcagggtcagggggctcaggcagtggaggctctttcgaagtgcaactggtggaatctgggggcggactggtgcagccaggcggaagtctgaggctgtcttgtgccgcctccggcagcatcttcggcttcaacgacatggcctggtatcggcaggctcccggaaaacagcgcgagctggtggctctgattagcagagtgggcgtgaccagcagcgccgactctgtgaagggcagattcacaatctccagagtgaacgccaaggatacagtgtacctccagatgaactctctgaaacctgaggatacagcagtgtactattgctacatggaccagcggctggacggcagcacactggcctactggggacagggaactcaagtgacagtgtctagc

SEQ ID NO: 442 - DNA, 726 bp, Artificial Sequence
  vHH domain
gacatccagatgacccagagccccagcagcctgtctgccagcgtgggcgacagagtgaccatcacctgtagagccagccaggacgtgaacaccgccgtggcctggtatcagcagaagcctggcaaggcccccaagctgctgatctacagcgccagcttcctggaaagcggcgtgcccagcagattcagcggaagcagaagcggcaccgacttcaccctgaccatcagctccctccagcccgaggacttcgccacctactactgccagcagcactacaccacccctcccaccttcggccagaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcaacatcaaggacacctacatccactgggtgcgccaggcccctggaaagggactggaatgggtggcccggatctaccccaccaacggctacaccagatacgccgacagcgtgaagggccggttcaccatcagcgccgacaccagcaagaataccgcctacctccagatgaacagcctgcgggccgaggataccgccgtgtactactgctcaagatggggaggcgacggcttctacgctatggacgtgtggggccagggcacccttgtgaccgtgtcatct

SEQ ID NO: 443 - DNA, 840 bp, Artificial Sequence
  vHH domain
gacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtctcgagggaggaggcggctccgggggaggcggaagtggaggcggaggatctgggtctggaggaagcggatctggaggctcagggtcagggggctcaggcagtggaggctctttcgaagtgcaactggtggaatctggaggctctctggtgcagccagggggaagcctgagactgtcttgtgccgcttccggcttcaccttcgacgactacgccatgagctgggtgcgccaggtgccaggcaaaggcctggaatgggtgtccagcatcaactggagcggcacccacaccgattacgccgactccgtgaaaggcagattcacaatcagcagaaacaacgccaacaataccctgtacctgcagatgaactccctgaagtctgaggatacagcagtgtattattgcgccaagaactggcgggacgccggcaccacttggtttgagaaaagcggctctgccggacagggaacccaagtgacagtgtcctcc

SEQ ID NO: 444 - DNA, 864 bp, Artificial Sequence
  vHH domain
gatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcctcgagggaggtagcggctccgggggaggcggaagtggaggcggaggatctgggtctggaggaagcggatctggaggctcagggtcagggggctcaggcagtggaggctctttcgaagtgcaactggtggagtccggcggtggactggtacagcctgggggttcactgcgcctgtcctgcgccgccagcggaagaacctattacctcaatgctatgggttggttccgccaggccccaggaaaggagcgcgagttcgtggcggctattgactggtccgaggggaacaaggactatgctgattccgtgaagggcaggtttaccatcagccgggataattcaaaaaatactgtttatttgcagatgaactctcttagaccagaagacactgctgtctattactgcgccgctgacacccctccttggggaccactgatttatatcgaaagctatgattcctgggggcagggcacactcgtcaccgtgagtagc

SEQ ID NO: 445 - DNA, 813 bp, Artificial Sequence
  vHH domain
caggtgcaactggtgcagtctggcggagggctggtgcagccagggggatctctgagactgagctgtgccgccagcgacttcgacttcgccgcctacgagatgagctgggtgcgccaggctcctggacagggactggaatgggtggccatcatcagccacgacggcatcgacaagtattacaccgacagcgtgaagggccggttcaccatcagccgggacaacagcaagaacaccctgtacctgcagatgaataccctgcgggccgaggacaccgccacctactattgcctgagactgggagccgtgggccagggcacacttgtgacagtgtctagcctcgagggaggaggcggctccgggggaggcggaagtggaggcggaggatctgggtctggaggaagcggatctggaggctcagggtcagggggctcaggcagtggaggcagcttcgaacaggtgcaactggtgcagagcggaggcggactggtgcagcctgggggcagtctgaggctgtcttgtgccgcctccgatttcgccttcgatgattacgagatgtcttgggtgcggcaggccccaggcaaagccctggaatggatcggcgacatcaaccacagcggcaccaccatctacaaccccagcctgaagtccagagtgaccatctccagagacaactccaagaatactctgtacctgcagatgaacacactgagagccgaagatacagccatctactactgcgccagaccccactacggcgactacagcgacgccttcgacatctggggccagggaaccatggtcaccgtgtcctct

SEQ ID NO: 446-447 - skipped (2 entries)

SEQ ID NO: 448 - DNA, 372 bp, Artificial Sequence
  non Immunoglobulin Antigen Binding Domain - Her2 DARPIN
ggctctgacctgggcatcaagctgctgttcgccgctgccaagggccaggacgacgaagtgcggattctgctggctgctggggccgacgtgaacgccaaggatttcgagggctacacccccctgcacgtggccgcctatgatggacacctggaaatcgtggaagtgctgctgaaggctggcgctgatgtgaatgccaaagacagccagggccggacccctctgcatgaagccgcctacagcggccatctggaaattgtggaagtgctgctgaaagccggggcagacgtgaacgctcaggacgacgctggcgagacaccagccgatctggctgcagcttggggccacgaagatatcgccgaggtgctgcagaag

SEQ ID NO: 449 - DNA, 378 bp, Artificial Sequence
  non Immunoglobulin Antigen Binding Domain - Her2 DARPIN
agaagcgatctgggaaagaagctgctggaagctgccagagccggacaggatgatgaagtgcgcatcctgatggcaaacggcgcagatgtgaacgcaaaggacgagtacggcctgacccccctgtacctggctacagcccacgggcacctggaaattgtggaagtgctgctgaagaacggcgctgacgtgaacgccgtggacgccatcggctttaccccactgcatctggccgctttcatcgggcatctcgaaatcgcagaggtgctgctgaaacacggggccgatgtgaatgcccaggacaagttcggcaagaccgccttcgacatcagcatcggcaacggcaacgaggacctggccgagatcctgcagaaactgaac

SEQ ID NO: 450 - DNA, 174 bp, Artificial Sequence
  Non Immunoglobulin Antigen Binding Domain - Her3 Affibody
gtggacaacaagttcaacaaagagcggtacagcgcctactacgagatttggcaactgcccaacctgaacgtgcggcagaaggccgccttcatcggatctctgcaggacgaccctagccagagcgccaatctgctggccgaggccaagaagctgaacgacgcccaggcccctaaa

SEQ ID NO: 451 - DNA, 153 bp, Artificial Sequence
  Non Immunoglobulin Antigen Binding Domain - Her2 Affibody
tacgccaaagagatgcggaacgcctactgggagatcgccctgctgcccaatctgaccaaccagcagaagagagcccccatcagaaagctgtacgacgacccctcccagagcagcgagctgctgtctgaggctaaaaaactgaacgatagccag

SEQ ID NO: 452 - DNA, 153 bp, Artificial Sequence
  Non Immunoglobulin Antigen Binding Domain - EGFR Affibody
tatgccaaagaaatgtggattgcctgggaggaaatccgcaacctgcctaatctgaatggctggcagatgaccgcctttatcgctaagctgctggatgaccccagccagtcctctgagctgctgagcgaagcaaagaaactgaatgactcccag

SEQ ID NO: 453-455 - skipped (3 entries)

SEQ ID NO: 456 - DNA, 807 bp, Homo sapiens
gaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgaaatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctcgagatcactgctcggccagtactatggcactggctgctgaggactggtggctgg

SEQ ID NO: 457 - DNA, 1470 bp, Homo sapiens
atgccctcctgggccctcttcatggtcacctcctgcctcctcctggcccctcaaaacctggcccaagtcagcagccaagatgtctccttgctggcatcagactcagagcccctgaagtgtttctcccgaacatttgaggacctcacttgcttctgggatgaggaagaggcagcgcccagtgggacataccagctgctgtatgcctacccgcgggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagtagagaagcttcagctctgacagcagagggtggaagctgcctcatctcaggactccagcctggcaactcctactggctgcagctgcgcagcgaacctgatgggatctccctcggtggctcctggggatcctggtccctccctgtgactgtggacctgcctggagatgcagtggcacttggactgcaatgctttaccttggacctgaagaatgttacctgtcaatggcagcaacaggaccatgctagctcccaaggcttcttctaccacagcagggcacggtgctgccccagagacaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctgtgcgcctccccaccccaaacttgcactggagggagatctccagtgggcatctggaattggagtggcagcacccatcgtcctgggcagcccaagagacctgttatcaactccgatacacaggagaaggccatcaggactggaaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccgcc

SEQ ID NO: 458 - DNA, 501 bp, Artificial Sequence
  Receptor Domain: CD8-SP-PD1-optimized-ECD
atggccttaccagtgaccgccttgctcctgccgctggccttgctgctccacgccgccaggccgggctggtttctggacagccctgacagaccctggaatcctccaacattcagccccgctctgctggtggttaccgagggcgataatgccaccttcacctgtagcttcagcaacaccagcgagagcttcgtgctgaactggtacagaatgagccccagcaaccagaccgacaagctggccgcctttcctgaggatagaagccagcctggacaggactgccggttcagagttacccagctgcctaacggcagagacttccacatgagcgttgtgcgggccagaagaaacgacagcggcacatatctgtgcggagccatctctctggcccctaaggctcagatcaaagagagcctgagagccgagctgagagtgacagaaagacgggccgaagtgcccacagctcacccttcaccttctccaagacctgccggccagttccag

SEQ ID NO: 459 - DNA, 438 bp, Artificial Sequence
  Receptor Domain: PD1-opt-ECD minus signal peptide
ggctggtttctggacagccctgacagaccctggaatcctccaacattcagccccgctctgctggtggttaccgagggcgataatgccaccttcacctgtagcttcagcaacaccagcgagagcttcgtgctgaactggtacagaatgagccccagcaaccagaccgacaagctggccgcctttcctgaggatagaagccagcctggacaggactgccggttcagagttacccagctgcctaacggcagagacttccacatgagcgttgtgcgggccagaagaaacgacagcggcacatatctgtgcggagccatctctctggcccctaaggctcagatcaaagagagcctgagagccgagctgagagtgacagaaagacgggccgaagtgcccacagctcacccttcaccttctccaagacctgccggccagttccag

SEQ ID NO: 460 - DNA, 501 bp, Homo sapiens
atgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaa

SEQ ID NO: 461 - DNA, 486 bp, Artificial Sequence
  Receptor Domain: CTLA4-optimized-ECD with signal peptide
atggcctgtctgggcttccagagacacaaggcccagctcaacctggctaccagaacctggccttgtactctgctgttcttcctgctgttcatccccgtgttctgcaaggccatgcatgtggctcagcctgctgtggtgctggcctctagtagaggaatcgccagcttcgtgtgcgagtacgcctctcctggaaaggccactgaagtgcgcgtgaccgttctgagacaggccgatagccaagtgaccgaagtgtgcgccgccacctacatgatgggcaacgagctgaccttcctggacgacagcatctgtaccggcaccagcagcggcaatcaagtgaacctgaccatccagggcctgagagctatggacaccggcctgtacatctgcaaggtggaactgatgtaccctcctccttactacctcggcatcggcaacggcacccaaatctacgtgatcgaccccgagccttgtcctgacagcgatttc

SEQ ID NO: 462 - DNA, 405 bp, Artificial Sequence
  Receptor Domain: NKGD2-ECD-minus-signal-peptide
ctgttcaaccaggaagtgcagatccccctgaccgagagctactgcggcccctgccccaagaactggatctgctacaagaacaactgctaccagttcttcgacgagagcaagaattggtacgagagccaggcttcctgcatgagccagaacgccagcctgctgaaggtgtacagcaaagaggaccaggatctgctgaagctggtcaagagctaccactggatgggcctggtgcacatccccaccaacggctcttggcagtgggaggacggcagcatcctgagccccaacctgctgaccatcatcgagatgcagaagggcgactgcgccctgtacgccagcagcttcaagggctacatcgagaactgctccacccccaacacctacatctgtatgcagcggaccgtg

SEQ ID NO: 463 - DNA, 624 bp, Artificial Sequence
  Receptor Domain: CD4-ECD with signal peptide
atggttaggggcgttccattcagacatctgcttctggtcttgcagcttgcactcttgcccgctgccacccagggcaaaaaagtggtgctgggcaagaaaggcgacaccgtggaactgacctgcaccgccagccagaagaagtccatccagttccactggaagaacagcaaccagatcaagatcctgggcaaccagggcagcttcctgaccaagggacccagcaagctgaacgacagagccgacagcagacggtccctgtgggaccagggcaatttcccactgattatcaagaacctgaagatcgaggacagcgacacctacatctgcgaggtggaagatcagaaagaagaggtgcaactgctggtgttcggcctgaccgccaactccgacacccatctgctccagggccagagcctgaccctgacactggaaagccctccaggcagctcccccagcgtgcagtgtagaagcccacgaggcaagaacatccagggaggcaaaacattgtcagtgtcccaactggaactccaggactccggcacctggacctgtaccgtgctccagaaccagaaaaaggtggagttcaagatcgacatcgtggtgctggccttccagaaagcctct

SEQ ID NO: 464 - DNA, 501 bp, Artificial Sequence
  Receptor Domain: DC-SIGN-minus-signal-peptide
atctaccaggaactgacacaactgaaggccgccgtggaacggctgtgccacccttgtccttgggagtggaccttctttcagggcaactgctacttcatgagcaacagccagcggaactggcacgacagcatcaccgcctgcaaagaagtgggagcccaactggtcgtgattaagagcgccgaggaacagaacttcctccaactccagagcagcagaagcaacagattcacctggatgggcctgagcgacctgaaccaggaaggcacctggcagtgggtggacggatctcctctgctgcccagcttcaagcagtattggaaccggggcgagcccaacaacgtgggcgaagaggattgcgccgagttcagcggcaacggctggaacgacgacaagtgcaacctggctaagttctggatctgcaagaagtccgccgcctcctgtagccgggatgaggaacagttcctgagccctgcccctgccacccctaatcctccaccagct

SEQ ID NO: 465 - DNA, 576 bp, Artificial Sequence
  Receptor domain: CD16A-V158-ECD-v1-minus-signal-peptide
ggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaa

SEQ ID NO: 466 - DNA, 576 bp, Artificial Sequence
  Receptor Domain: CD16A-V158-ECD-v2-minus-signal-peptide
ggcatgagaaccgaggacctgcctaaggccgtggtgttcctggaaccccagtggtacagagtgctggaaaaggacagcgtgaccctgaagtgccagggcgcctacagccccgaggacaatagcacccagtggttccacaacgagagcctgatctccagccaggccagcagctacttcatcgacgccgccaccgtggacgacagcggcgagtatagatgccagaccaacctgagcaccctgagcgaccccgtgcagctggaagtgcacatcggatggctgctgctgcaggcccccagatgggtgttcaaagaagaggaccccatccacctgagatgccactcttggaagaacaccgccctgcacaaagtgacctacctgcagaacggcaagggcagaaagtacttccaccacaacagcgacttctacatccccaaggccaccctgaaggactccggctcctacttctgcagaggcctcgtgggcagcaagaacgtgtccagcgagacagtgaacatcaccatcacccagggcctggccgtgtctaccatcagcagctttttcccacccggctaccag

SEQ ID NO: 467 - DNA, 822 bp, Artificial Sequence
  Receptor Domain: dc-Avidin-minus signal peptide
gccagaaagagaacccagcccaccttcggcttcaccgtgaactggaagttcagcgagagcaccaccgtgttcaccggccagtgcttcatcgaccggaacggcaaagaggtgctgaaaaccatgtggctgctgcggagcagcgtgaacgacatcggcgacgactggaaggccaccagagtgggcatcaacatcttcacccggctgcggacacagaaagagggcggctctggcggaagcgccagaaagtgtagcctgaccggcaagtggaccaacgacctgggcagcaacatgaccatcggagccgtgaacagcagaggcgagtttaccggcacctacatcaccgccgtgaccgccaccagcaacgagatcaaagagagccccctgcacggcacccagaacaccatcaacaagagcggcggcagcacaacagtgtttacaggacagtgctttattgaccgcaatgggaaagaagtgctgaaaacaatgtggctgctgaggtcctccgtgaatgacattggagatgattggaaagctacaagagtggggattaacatttttaccagactgaggacccagaaagaagggggcagcggaggctccgccagaaaatgctctctgacagggaagtggacaaatgatctggggtccaatatgacaatcggcgctgtgaactctcggggcgagttcactggaacatatattacagccgtgacagctacctctaacgaaatcaaagagtctcctctgcacgggacacagaataccattaacaaacggacccagcctacatttgggtttacagtgaattggaaattctccgag

SEQ ID NO: 468 - DNA, 1698 bp, Artificial Sequence
  Autoantigen: Desmoglein-3 (Dsg3)-ECD-codon optimized
gagtgggtcaagttcgccaagccttgcagagaaggcgaggacaacagcaagcggaaccctatcgccaagatcaccagcgactaccaggccacacagaagatcacctaccggatctctggcgtgggcatcgaccagcctccattcggcatcttcgtggtggacaagaacaccggcgacatcaacatcaccgccatcgtggacagagaggaaacccctagcttcctgattacctgtagagccctgaacgcccagggcctcgatgtggaaaagcctctgatcctgaccgtgaagatcctggacatcaacgacaaccctccagtgttcagccagcagattttcatgggcgagatcgaggaaaacagcgccagcaacagcctggtcatgatcctgaatgccaccgacgccgacgagcccaaccacctgaatagcaagatcgccttcaagatcgtgtcccaagagcctgccggcacacccatgtttctgctgtccagaaataccggcgaagtgcggaccctgaccaatagcctggatagagagcaggccagcagctacagactggtggtgtctggcgctgacaaggatggcgagggactgagcacccagtgcgagtgcaacatcaaagtgaaggacgtgaacgacaacttccccatgttccgggacagccagtatagcgcccggatcgaagagaacatcctgagcagcgagctgctgcggttccaagtgaccgacctggacgaagagtacaccgacaactggctggccgtgtacttcttcaccagcggcaacgaaggcaactggttcgagatccagacagaccccaggaccaacgagggcatcctgaaggttgtgaaggccctggactacgagcagctccagagcgtgaagctgtctatcgccgtgaagaacaaggccgagttccaccagtccgtgatctcccggtacagagtgcagagcacccctgtgaccatccaagtgattaacgtgcgcgagggcattgccttcagacccgccagcaagaccttcaccgtgcagaagggcatcagcagcaagaaactggtggactacatcctgggcacctatcaggccatcgacgaggacacaaacaaagccgcctccaacgtgaaatacgtgatgggcagaaacgacggcggctacctgatgatcgactccaagaccgccgagatcaagttcgtgaagaatatgaaccgggactccaccttcatcgtgaacaagaccatcacagccgaggtgctggctatcgacgagtataccggcaagaccagcaccggcacagtgtatgtgcgggtgcccgacttcaacgataactgccctacagccgtgctggaaaaggacgccgtgtgtagctctagccctagcgtggtcgtgtccgccagaacactgaacaacagatacacaggcccctacacattcgccctggaagatcagcctgtgaagctgcctgccgtgtggtccatcaccacactgaatgctacaagcgccctgctgagagcccaagagcaaattcctcctggcgtgtaccacatcagcctggtgctgacagacagccagaacaatagatgcgagatgcctcggagcctgacactggaagtgtgccagtgcgacaacagaggcatctgcggcacaagctaccccacaacaagccccggcacaagatacggcagacctcactctggaaga

SEQ ID NO: 469-475 - skipped (7 entries)

SEQ ID NO: 476 - DNA, 561 bp, Artificial Sequence
  Ligand
atggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggaccctaatgccatcttcctgagcttccaacacctgctccgaggaaaggtgcgtttcctgatgcttgtaggagggtccaccctctgcgtcaggcgggccccacccaccacagctgtccccagcagaacctct

SEQ ID NO: 477 - DNA, 561 bp, Artificial Sequence
  Ligand
atggagctgactgatttgctcctggcggccatgcttcttgcagtggcaagactaactctgtccagccccgtagctcctgcctgtgaccccagactcctaaataaactgctgcgtgactcccacctccttcacagccgactgagtcagtgtcccgacgtggaccctttgtctatccctgttctgctgcctgctgtggactttagcctgggagaatggaaaacccagacggaacagagcaaggcacaggacattctaggggcagtgtcccttctactggagggagtgatggcagcacgaggacagttggaaccctcctgcctctcatccctcctgggacagctttctgggcaggttcgcctcctcttgggggccctgcagggcctcctaggaacccagcttcctctacagggcaggaccacagctcacaaggaccccaatgccctcttcttgagcttgcaacaactgcttcggggaaaggtgcgcttcctgcttctggtagaaggtcccaccctctgtgtcagacggaccctgccaaccacagctgtcccaagcagtacttct

SEQ ID NO: 478 - DNA, 276 bp, Artificial Sequence
  Ligand
gctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagc

SEQ ID NO: 479 - DNA, 495 bp, Artificial Sequence
  Ligand
atggaaatgttccagggcctgctgctgctcctgctgctttctatgggaggcacatgggccagcagagagatgctgaggcccagatgcagacccatcaatgccacactggccgtggaaaaagagggctgccctgtctgcatcaccgtgaacaccacaatctgcgccggctactgccccaccatgacaagagttctgcaaggcgtgctgcccgctctgcctcaggtcgtgtgcaactatcgggacgtccgcttcgagagcatcagactgcctggatgtcccagaggcgtgaaccctgtggtgtcttatgccgtggctctgagctgtcagtgcgccctgtgtagaagaagcaccaccgattgcggcggacccaaggatcaccctctgacctgtgacgaccctagattccaggccagcagcagctctaaagcccctccaccttctctgccatctccaagcagactgcccggacctagcgacacacctattctgcctcaa

SEQ ID NO: 480 - DNA, 333 bp, Artificial Sequence
  Ligand
aacagctgcgagctgaccaacatcacaatcgccatcgagaaagaggaatgccggttctgcatcagcatcaacaccacttggtgcgccggctactgctacacccgcgatctggtgtataaggaccccgccagacctaagatccagaaaacctgcaccttcaaagagctggtctacgagacagtcagagtgcctggatgtgcccaccacgccgatagcctgtacacataccctgtggctacccagtgccactgcggcaagtgtgatagcgacagcaccgattgcaccgtcagaggactgggacccagctactgtagcttcggcgagatgaaggaa

SEQ ID NO: 481 - DNA, 423 bp, Artificial Sequence
  Ligand
atggaaatgctccagggcctgctgctgctcctgctgctttctatgggcggagcttgggccagcagagagcctcttagaccttggtgtcaccccatcaacgccatcctggccgtggaaaaagagggctgccctgtctgcatcaccgtgaacaccacaatctgcgccggctactgccccaccatgatgagagtgctgcaagccgttctgcctcctctgcctcaggtcgtgtgcacctatcgggacgtccgcttcgagagcatcagactgcctggatgtcctagaggcgtggaccccgtggtgtcttttcctgtggctctgtcctgtagatgcggcccctgtagaagaagcaccagcgattgcggcggacccaaggatcaccctctgacatgcgatcacccacagctgagcggcctgttgtttctt

SEQ ID NO: 482 - DNA, 414 bp, Artificial Sequence
  Ligand
atgacagccctgttcctgatgtccatgctgttcggcctggcctgcggacaggccatgtctttctgtatccccaccgagtacaccatgcacatcgagagaagagagtgcgcctactgcctgaccatcaacaccacaatctgcgccggctactgcatgacacgggatattaacggcaagctgttcctgcctaagtacgccctgagccaggacgtgtgcacctaccgggacttcatctaccggaccgtggaaatccctggctgccctctgcatgtggccccttactttagctaccccgtggctctgagctgcaagtgcggcaagtgcaacaccgactacagcgactgtatccacgaggccatcaagaccaactactgcaccaagcctcagaaaagctacctcgtgggcttctctgtt

SEQ ID NO: 483 - DNA, 816 bp, Artificial Sequence
  Ligand
atggaaatgttccagggcctgctgctgctcctgctgctttctatgggaggcacatgggccagcagagagatgctgaggcccagatgcagacccatcaatgccacactggccgtggaaaaagagggctgccctgtctgcatcaccgtgaacaccacaatctgcgccggctactgccccaccatgacaagagttctgcaaggcgtgctgcccgctctgcctcaggtcgtgtgcaactatcgggacgtccgcttcgagagcatcagactgcctggatgtcccagaggcgtgaaccctgtggtgtcttatgccgtggctctgagctgtcagtgcgccctgtgtagaagaagcaccaccgattgcggcggacccaaggatcaccctctgacctgtgacgaccctagattccaggccagcagcagctctaaagcccctccaccttctctgccatctccaagcagactgcccggacctagcgacacacctattctgcctcaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagc

SEQ ID NO: 484 - DNA, 717 bp, Artificial Sequence
  Ligand
atggccttaccagtgaccgccttgctcctgccgctggccttgctgctccacgccgccaggccgaacagctgcgagctgaccaacatcacaatcgccatcgagaaagaggaatgccggttctgcatcagcatcaacaccacttggtgcgccggctactgctacacccgcgatctggtgtataaggaccccgccagacctaagatccagaaaacctgcaccttcaaagagctggtctacgagacagtcagagtgcctggatgtgcccaccacgccgatagcctgtacacataccctgtggctacccagtgccactgcggcaagtgtgatagcgacagcaccgattgcaccgtcagaggactgggacccagctactgtagcttcggcgagatgaaggaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagc

SEQ ID NO: 485 - DNA, 744 bp, Artificial Sequence
  Ligand
atggaaatgctccagggcctgctgctgctcctgctgctttctatgggcggagcttgggccagcagagagcctcttagaccttggtgtcaccccatcaacgccatcctggccgtggaaaaagagggctgccctgtctgcatcaccgtgaacaccacaatctgcgccggctactgccccaccatgatgagagtgctgcaagccgttctgcctcctctgcctcaggtcgtgtgcacctatcgggacgtccgcttcgagagcatcagactgcctggatgtcctagaggcgtggaccccgtggtgtcttttcctgtggctctgtcctgtagatgcggcccctgtagaagaagcaccagcgattgcggcggacccaaggatcaccctctgacatgcgatcacccacagctgagcggcctgttgtttcttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagc

SEQ ID NO: 486 - DNA, 735 bp, Artificial Sequence
  Ligand
atgacagccctgttcctgatgtccatgctgttcggcctggcctgcggacaggccatgtctttctgtatccccaccgagtacaccatgcacatcgagagaagagagtgcgcctactgcctgaccatcaacaccacaatctgcgccggctactgcatgacacgggatattaacggcaagctgttcctgcctaagtacgccctgagccaggacgtgtgcacctaccgggacttcatctaccggaccgtggaaatccctggctgccctctgcatgtggccccttactttagctaccccgtggctctgagctgcaagtgcggcaagtgcaacaccgactacagcgactgtatccacgaggccatcaagaccaactactgcaccaagcctcagaaaagctacctcgtgggcttctctgttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagc

SEQ ID NO: 487 - skipped

SEQ ID NO: 488 - DNA, 726 bp, Artificial Sequence
  Single Chain Variable Fragment (scFv)
gacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctca

SEQ ID NO: 489 - DNA, 726 bp, Artificial Sequence
  Single Chain Variable Fragment (scFv)
gagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagt

SEQ ID NO: 490 - DNA, 729 bp, Artificial Sequence
  Single Chain Variable Fragment (scFv)
gacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagt

SEQ ID NO: 491 - DNA, 750 bp, Artificial Sequence
  Single Chain Variable Fragment (scFv)
gacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagt

SEQ ID NO: 492 - DNA, 747 bp, Artificial Sequence
  Single Chain Variable Fragment (scFv)
gacatcgtgatgacccaggccgctcccagcatccctgtgacacctggcgagagcgtgtccatctcctgccggtctagcaagagcctgctgaacagcaacggcaatacctacctgtactggttcctccagcggccaggccagtctccccaactgctgatctaccggatgagcaacctggcctccggcgtgcccgatagattttctggcagcggctccggcaccgccttcaccctgagaatcagcagagtggaagccgaggacgtgggcgtgtactactgtatgcagcacctggaataccccttcaccttcggagccggcaccaagctggaactgaagagaggcggaggcggaagtggaggcggaggatctggcggcggaggctctgaagtgcaactccagcagagcggccctgagctgattaagcctggggccagcgtgaagatgagctgcaaggccagcggctacaccttcaccagctacgtgatgcactgggtcaagcagaagcccggccagggcctggaatggatcggctacatcaacccctacaacgatggcaccaagtacaacgagaagttcaagggcaaggccaccctgaccagcgacaagagcagcagcaccgcctacatggaactgagcagcctgacaagcgaggacagcgccgtgtactattgcgccagaggcacctactactacggcagccgggtgttcgactattggggccagggcaccacactgaccgtgtcctct

SEQ ID NO: 493 - DNA, 720 bp, Artificial Sequence
  Single Chain Variable Fragment (scFv)
tacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaaggcggaggcggaagtggaggcggaggatctggcggcggaggctctagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgct

SEQ ID NO: 494 - DNA, 753 bp, Artificial Sequence
  Single Chain Variable Fragment (scFv)
gacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagggcggaggcggaagtggaggcggaggatctggcggcggaggctctgggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctct

SEQ ID NO: 495 - DNA, 726 bp, Artificial Sequence
  Single Chain Variable Fragment (scFv)
gacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacggcggaggcggaagtggaggcggaggatctggcggcggaggctctgctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagt

SEQ ID NO: 496 - DNA, 750 bp, Artificial Sequence
  Single Chain Variable Fragment (scFv)
gatgttgtgatgactcagtctccactctccctgcccgtcacccctggagcgccggcctccatctcctgcagatccagtcagagcattgtacatagtaatggaaacacctatttagagtggtatcttcaaaagccagggcagtctccaaagctcctgatctataaagtttccaaccgattttctggagtccctgacaggttcagtggaagtggatcaggcacagattttacactgagaatcagcagagtggaggctgaggatgttggaatttattactgctttcaaggttcacatgttcctccgacgttcggccctgggaccaaattggaaatcaaaggcggaggcggaagtggaggcggaggatctggcggcggaggctctgaagtgcagctggtggagtctgggggaggcttggtccagcctggggggtccctgagactctcctgttcagcctctggattcacctttagtagctttggaatgcactgggtccgccaggctccagggaaggggctggaatgggtggcctacattagtagtggcagtagtaccatctactatggagacaccgtgaagggccgattcaccatctccagagacaacgccaagaactcactgtttctgcaaatgagcagcctgagagccgaggacacggccgtgtattattgtgcgagagaggggggatattactacggaaggagttactatactatggactactggggccaagggaccacggtcaccgtctcc

SEQ ID NO: 497 - DNA, 738 bp, Artificial Sequence
  Single Chain Variable Fragment (scFv)
gacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaaggcggaggcggaagtggaggcggaggatctggcggcggaggctctcaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctca

SEQ ID NO: 498 - DNA, 732 bp, Artificial Sequence
  Single Chain Variable Fragment (scFv)
gacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagc

SEQ ID NO: 499 - DNA, 732 bp, Artificial Sequence
  Single Chain Variable Fragment (scFv)
gacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctct

SEQ ID NO: 500 - DNA, 735 bp, Artificial Sequence
  Single Chain Variable Fragment (scFv)
cagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtggcggaggcggaagtggaggcggaggatctggcggcggaggctctcaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatct

SEQ ID NO: 501 - DNA, 729 bp, Artificial Sequence
  Single Chain Variable Fragment (scFv)
caggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtggcggaggcggaagtggaggcggaggatctggcggcggaggctctgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatct

SEQ ID NO: 502 - DNA, 735 bp, Artificial Sequence
  Single Chain Variable Fragment (scFv)
gacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagggcggaggcggaagtggaggcggaggatctggcggcggaggctctcaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctct

SEQ ID NO: 503 - DNA, 735 bp, Artificial Sequence
  Single Chain Variable Fragment (scFv)
gaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagaggcggaggcggaagtggaggcggaggatctggcggcggaggctctcaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagc

SEQ ID NO: 504 - DNA, 735 bp, Artificial Sequence; identical to SEQ ID NO: 503
  Single Chain Variable Fragment (scFv)

SEQ ID NO: 505 - DNA, 732 bp, Artificial Sequence
  Single Chain Variable Fragment (scFv)
gagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatct

SEQ ID NO: 506 - DNA, 741 bp, Artificial Sequence
  Single Chain Variable Fragment (scFv)
gacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagc

SEQ ID NO: 507 - DNA, 744 bp, Artificial Sequence
  Single Chain Variable Fragment (scFv)
gacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagc

SEQ ID NO: 508 - DNA, 720 bp, Artificial Sequence
  Single Chain Variable Fragment (scFv)
gacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggggcggaggcggaagtggaggcggaggatctggcggcggaggctctcaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctct

SEQ ID NO: 509 - DNA, 738 bp, Artificial Sequence
  Single Chain Variable Fragment (scFv)
gacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagc

SEQ ID NO: 510 - DNA, 717 bp, Artificial Sequence
  Single Chain Variable Fragment (scFv)
gacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagc

SEQ ID NO: 511 - DNA, 729 bp, Artificial Sequence
  Single Chain Variable Fragment (scFv)
gagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctct

SEQ ID NO: 512 - DNA, 723 bp, Artificial Sequence
  Single Chain Variable Fragment (scFv)
gacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatct

SEQ ID NO: 513 - DNA, 750 bp, Artificial Sequence
  Single Chain Variable Fragment (scFv)
gacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctct

SEQ ID NO: 514 - DNA, 738 bp, Artificial Sequence
  Single Chain Variable Fragment (scFv)
gagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatct

SEQ ID NO: 515 - DNA, 750 bp, Artificial Sequence
  Single Chain Variable Fragment (scFv)
gatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagaggcggaggcggaagtggaggcggaggatctggcggcggaggctctcagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctct

SEQ ID NO: 516 - DNA, 708 bp, Artificial Sequence
  Single Chain Variable Fragment (scFv)
gagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagggcggaggcggaagtggaggcggaggatctggcggcggaggctctttcgaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctct

SEQ ID NO: 517 - DNA, 735 bp, Artificial Sequence
  Single Chain Variable Fragment (scFv)
gacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggggcggaggcggaagtggaggcggaggatctggcggcggaggctctcaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctct

SEQ ID NO: 518 - DNA, 723 bp, Artificial Sequence
  Single Chain Variable Fragment (scFv)
gacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagc

SEQ ID NO: 519 - DNA, 747 bp, Artificial Sequence
  Single Chain Variable Fragment (scFv)
gacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagc

SEQ ID NO: 520 - DNA, 732 bp, Artificial Sequence
  Single Chain Variable Fragment (scFv)
gacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagc

SEQ ID NO: 521 - DNA, 717 bp, Artificial Sequence
  Single Chain Variable Fragment (scFv)
gacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctct

SEQ ID NO: 522 - DNA, 726 bp, Artificial Sequence
  Single Chain Variable Fragment (scFv)
gagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagaggcggaggcggaagtggaggcggaggatctggcggcggaggctctcaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagc

SEQ ID NO: 523 - DNA, 711 bp, Artificial Sequence
  Single Chain Variable Fragment (scFv)
cagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagggcggaggcggaagtggaggcggaggatctggcggcggaggctctgatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgct

SEQ ID NO: 524 - DNA, 741 bp, Artificial Sequence
  Single Chain Variable Fragment (scFv)
gacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagt

SEQ ID NO: 525 - DNA, 717 bp, Artificial Sequence
  Single Chain Variable Fragment (scFv)
gacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctct

SEQ ID NO: 526 - DNA, 726 bp, Artificial Sequence
  Single Chain Variable Fragment (scFv)
gacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatct

SEQ ID NO: 527 - DNA, 756 bp, Artificial Sequence
  Single Chain Variable Fragment (scFv)
gacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagaggcggaggcggaagtggaggcggaggatctggcggcggaggctctgaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagt

SEQ ID NO: 528 - DNA, 747 bp, Artificial Sequence
  Single Chain Variable Fragment (scFv)
gagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagaggcggaggcggaagtggaggcggaggatctggcggcggaggctctcaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatct

SEQ ID NO: 529 - DNA, 723 bp, Artificial Sequence
  Single Chain Variable Fragment (scFv)
gacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagggcggaggcggaagtggaggcggaggatctggcggcggaggctctcaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgct

SEQ ID NO: 530 - DNA, 702 bp, Artificial Sequence
  Single Chain Variable Fragment (scFv)
atgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagaggcggcggaggatctggcggaggcggatctgggggcggaggctctgaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatct

SEQ ID NO: 531 - DNA, 717 bp, Artificial Sequence
  Single Chain Variable Fragment (scFv)
cagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagggcggaggcggaagtggaggcggaggatctggcggcggaggctctcaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctct

SEQ ID NO: 532 - DNA, 726 bp, Artificial Sequence
  Single Chain Variable Fragment (scFv)
gacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagggcggaggcggaagtggaggcggaggatctggcggcggaggctctgaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctct

SEQ ID NO: 533 - DNA, 741 bp, Artificial Sequence
  Single Chain Variable Fragment (scFv)
gacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctct

SEQ ID NO: 534 - DNA, 774 bp, Artificial Sequence
  Single Chain Variable Fragment (scFv)
gacctgaacttcatgctgacccagccccacagcgtgtccggcagccctggaaagaccgtgaccatctcctgcaccagaagcaccggcagcatcaccagcaactacgtgcactggtatcagcagaggcccggcagcagccctaccaccgtgatctgcgaggacaacgagaggccaagcggcgtgcccgatagattcagcggctccatcgacatcagcagcaacagcgccagcctgaccatcagcggcctgaaaaccgaggacgaggccgactactactgccagagctacgacgacagcaaccacatctccgtgttcggcaccgggaccaaagtgaccgtgctgggacagcccaaggccaatcctggcggaggcggaagtggaggcggaggatctggcggcggaggctctcaggtgcaactgcaggaatctggccctggcctcgtgaagcccagcgagacactgagcctgacctgcacagtgtccggcggcagcattagcagcagcaattactactggggctggattcggcagccccctggcaagggactggaatggatcggagccatctactacagcggcagcacctactacaaccccagcctgaagtccagagtggctatcagcgtggacaccagcaagaaccagttctccctgaagctgagcagcgtgacagccgccgataccgccgtgtactactgcgccagacggatcggagtggccggacagtggtacttcgacctgtggggcagaggaaccctcgtgaccgtgtctagc

SEQ ID NO: 535 - DNA, 732 bp, Artificial Sequence
  Single Chain Variable Fragment (scFv)
gacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagggcggaggcggaagtggaggcggaggatctggcggcggaggctctcagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctca

SEQ ID NO: 536 - DNA, 723 bp, Artificial Sequence
  Single Chain Variable Fragment (scFv)
gacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatct

SEQ ID NO: 537 - DNA, 726 bp, Artificial Sequence
  Single Chain Variable Fragment (scFv)
gacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagc

SEQ ID NO: 538 - DNA, 744 bp, Artificial Sequence
  Single Chain Variable Fragment (scFv)
cagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagc

SEQ ID NO: 539 - DNA, 744 bp, Artificial Sequence
  Single Chain Variable Fragment (scFv)
cagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagc

SEQ ID NO: 540 - DNA, 738 bp, Artificial Sequence
  Single Chain Variable Fragment (scFv)
gacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagt

SEQ ID NO: 541 - DNA, 723 bp, Artificial Sequence
  Single Chain Variable Fragment (scFv)
gagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagaggcggaggcggaagtggaggcggaggatctggcggcggaggctctcaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctct

SEQ ID NO: 542 - DNA, 723 bp, Artificial Sequence
  Single Chain Variable Fragment (scFv)
agcaccgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacctggccagcaacctgcagagcggcgtgcccagcagattttctggcagcggctccggcaccgacttcaccctgacaatcagctccctgcagcccgaggacttcgccacctactactgtcagcaggccgagtacatgcccctgaccttcggccagggaacaaaggtggaaatcaagagagccggcggaggcggaagtggaggcggaggatctggcggcggaggctctgaagtgcaactgctggaatctggcggcggactggtgcagcctggcggatctctgagactgagctgtgccgccagcggcttcacctttagcggctacgccatgagctgggtgcgccaggctcctggcaaaggcctggaatgggtgtccgagatcgcccctcccggcctgaataccagatacgccgatagcgtgaagggccggttcaccatcagccgggacaacagcaagaacaccctgtacctgcagatgaacagcctgcgggccgaggataccgccgtgtactactgcgccaagagcgacaccgccttcgactactggggacagggaacccttgtgaccgtgtcc

SEQ ID NO: 543 - DNA, 735 bp, Artificial Sequence
  Single Chain Variable Fragment (scFv)
gaccaggccgtgctgacccaggagagcgccctgaccaccagccccggcgagaccgtgaccctgacctgcagaagcagcaccggcgccgtgaccaccagcaactacgccaactgggtgcaggagaagcccgaccacctgttcaccggcctgatcggcggcaccaacaacagagtgcccggcgtgcccgccagattcagcggcagcctgatcggcgacaaggccgccctgaccatcaccggcgcccagaccgaggacgaggccatctacttctgcgtgctgtggcacagcaaccactgggtgttcggcggcggcaccaagctgaccgtgctgggcggaggcggaagtggaggcggaggatctggcggcggaggctctgacgtgcagctggtggagagcggcggcggcctggtgcagcccggcggcagcagaaagctgagctgcgccgccagcggcttcaccttcagcagcttcgggatgcactgggtgagacaggcccccgagaagggcctggagtgggtggcctacatcagcagcggcagcagcaccctgcactacgccgacaccgtgaagggcagattcaccatcagcagagacaaccccaagaacaccctgttcctgcagatgaccagcctgagaagcgaggacaccgccatgtactactgcgccagatggggcaactacccccactacgctatggactactggggccagggcaccagcgtgaccgtgagcagc

SEQ ID NO: 544 - DNA, 708 bp, Artificial Sequence
  Single Chain Variable Fragment (scFv)
gacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaaggcggaggcggaagtggaggcggaggatctggcggcggaggctctgaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctct

SEQ ID NO: 545 - DNA, 723 bp, Artificial Sequence
  Single Chain Variable Fragment (scFv)
gagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcggcggaggcggaagtggaggcggaggatctggcggcggaggctctgatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaag

SEQ ID NO: 546 - DNA, 744 bp, Artificial Sequence
  Single Chain Variable Fragment (scFv)
gagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagggcggaggcggaagtggaggcggaggatctggcggcggaggctctgaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagt

SEQ ID NO: 547 - DNA, 747 bp, Artificial Sequence
  Single Chain Variable Fragment (scFv)
gagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagggcggaggcggaagtggaggcggaggatctggcggcggaggctctgaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatct

SEQ ID NO: 548 - DNA, 738 bp, Artificial Sequence
  Single Chain Variable Fragment (scFv)
gacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagggcggaggcggaagtggaggcggaggatctggcggcggaggctctgtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagt

SEQ ID NO: 549 - DNA, 732 bp, Artificial Sequence
  Single Chain Variable Fragment (scFv)
gacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagggcggaggcggaagtggaggcggaggatctggcggcggaggctctgaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtct

SEQ ID NO: 550 - DNA, 738 bp, Artificial Sequence
  Single Chain Variable Fragment (scFv)
gacatccagatgacacagagccctagcagcctgtctgccagcgtgggagacagagtgaccatcacctgtagaaccagccagagcctgagcagctacacccactggtatcagcagaagcctggcaaggcccctaagctgctgatctatgccgcttccagcagaggcagcggagtgcctagcagattttctggcagcggctccggcaccgatttcaccctgacaatatccagcctccagcctgaggacttcgccacctactactgccagcagagcagaacattcggccagggcaccaaggtggaaatcaaaggcggaggcggaagtggaggcggaggatctggcggcggaggctctcaagttcagctccagcagtctggccctggcctggttaagcctagccagacactgagcctgacctgtgccatcagcggcgatagcgtgtccagctacaacgccgtgtggaactggatcagacagagcccatccagaggactggaatggctgggcagaacctactacagaagcggctggtacaacgactacgccgagagcgtgaagtcccggatcaccatcaatcccgacaccagcaagaaccagttcagcctgcaactgaacagcgtgacccctgaggataccgccgtgtactactgtgctagaagcggccacatcaccgtgttcggcgtgaacgtggacgccttcgatatgtggggccagggaacaatggtcaccgtgtctagt

SEQ ID NO: 551 - DNA, 735 bp, Artificial Sequence
  Single Chain Variable Fragment (scFv)
gacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggggcggaggcggaagtggaggcggaggatctggcggcggaggctctcaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagt

SEQ ID NO: 552 - DNA, 747 bp, Artificial Sequence
  Single Chain Variable Fragment (scFv)
gacctggaaaccaccctgacacagagccctgccaccctgagtgtgtccccaggcgagagagtgaccctgagctgtagagccagccagagcgtgggcagcaacctggcctggtatcagcagaagttcggccaggcccccagactgctgatctacgacgccagcacaagagccaccggcatccccgccagattttctggcagcggctccggcaccgagttcaccctgaccatcagcagactggaacccgaggacttcgccgtgtactactgccaccagtacggcagcagccccagaacctttggacagggcaccaaggtggacatcaagcggggcggaggcggaagtggaggcggaggatctggcggcggaggctctcaggtgcaactggtgcagagcggagccgaagtgaagaaacctggggccagcgtgaaggtgtcctgcaaggccagcggctacacctttaccacctacggcatctcttgggtgcgccaggctcctggacagggactggaatggatgggctggatcagcgcctacaacggccacaccaactacgcccagatgctccagggcagagtgaccatgaccaccgacaccagcacctccaccgcctacatggaactgcggggcctgagaagcgacgacaccgccgtgtattattgcgccagagaagcctacgcctcctacggcagcggcagctactggaccgattattggggccagggcaccctcgtgaccgtgtctagt

SEQ ID NO: 553 - DNA, 723 bp, Artificial Sequence
  Single Chain Variable Fragment (scFv)
gacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagggcggaggcggaagtggaggcggaggatctggcggcggaggctctgaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagt

SEQ ID NO: 554 - DNA, 717 bp, Artificial Sequence
  Single Chain Variable Fragment (scFv)
gagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggggcggaggcggaagtggaggcggaggatctggcggcggaggctctcaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctct

SEQ ID NO: 555 - DNA, 726 bp, Artificial Sequence
  Single Chain Variable Fragment (scFv)
gacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagaggcggaggcggaagtggaggcggaggatctggcggcggaggctctgaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatct

SEQ ID NO: 556 - DNA, 732 bp, Artificial Sequence
  Single Chain Variable Fragment (scFv)
cagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacaggcggaggcggaagtggaggcggaggatctggcggcggaggctctgagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatct

SEQ ID NO: 557 - DNA, 747 bp, Artificial Sequence
  Single Chain Variable Fragment (scFv)
cagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacaggcggaggcggaagtggaggcggaggatctggcggcggaggctctcagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagc

SEQ ID NO: 558 - DNA, 729 bp, Artificial Sequence
  Single Chain Variable Fragment (scFv)
gacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagggcggaggcggaagtggaggcggaggatctggcggcggaggctctgaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatct

SEQ ID NO: 559 - DNA, 732 bp, Artificial Sequence
  Single Chain Variable Fragment (scFv)
gacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagc

SEQ ID NO: 560 - DNA, 729 bp, Artificial Sequence
  Single Chain Variable Fragment (scFv)
cagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtggcggaggcggaagtggaggcggaggatctggcggcggaggctctgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttct

SEQ ID NO: 561 - DNA, 726 bp, Artificial Sequence
  Single Chain Variable Fragment (scFv)
cagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtggcggaggcggaagtggaggcggaggatctggcggcggaggctctgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtg

SEQ ID NO: 562 - DNA, 726 bp, Artificial Sequence
  Single Chain Variable Fragment (scFv)
gacaacatcgagctgacccagagccccgccatcatgagtgcctctccaggcgagcgcgtgaccatgacatgtagcgccagcagcagcatccggtacatctactggtatcagcagaagcccggcagcagccccagactgctgatctacgacaccagcaacgtggcccctggcgtgccctttagattttccggcagcggctccggcaccagctacagcctgaccatcaaccggatggaagccgaggacgccgccacctactattgtcaggaatggagcggctacccctacaccttcggcggaggcaccaagctggacatcaagagaggcggaggcggaagtggaggcggaggatctggcggcggaggctctcaagtgaagctccaggaatctggcggcggactcgtgaagcctggcggctctctgaagctgagctgtgccgccagcggcttcaccttcagcagctacggcatgagctgggtgcgccagacccccgacaagagactggaatgggtggcaaccatcagcagcggcggcagctacacctactaccccgatagcgtgaagggccggttcaccatctccagagacaacgccaagaacaccctgtacctccagatgagcagcctgaagtccgaggataccgccatgtactactgcgccagaggcaactgggagggctggtacttcgatgtgtggggccagggcaccaccgtgaccgtgtcatct

SEQ ID NO: 563 - DNA, 756 bp, Artificial Sequence
  Single Chain Variable Fragment (scFv)
gacaacttcatgctgacccagccccacagcgtgtccgagagccctggcaagaccgtgaccatctcctgtaccggcagcggcggcagcatcgacaacaactacgtgcactggtatcagcagaggcccggcagcgcccctaccaccgtgatgttcgaggacaaccagaggcccagcggcgtgcccgatagattcagcggctctatcgacagcagcagcaacagcgccagcctcgtgatctccggcctgaaaaccgaggacgagggcgactactactgccagagcagcgacggctccaaggtggtgtttggcggaggcaccaagctgaccgtgctgggacagggcggaggcggaagtggaggcggaggatctggcggcggaggctctgaagtgcaactggtgcagagcggcggaggctctctgacactgtcttgtgctgcctccggcgtggtgcagcctggcagattcaccttcagcagctacggaatgcactgggtgcgccaggcccctggaaagggactggaatgggtgtccgtgatctcttacgacggcagcaacaagtattacgccgacagcgtgaagggccggttcaccatctccagagacaacagcaagaacaccctgtacctccagatgaacagcctgcggaccgaggacaccgccgtgtactactgtgccaagaccctgtccgctggcgagtggattggaggcggagccttcgatatctggggccacggcacaatggtcaccgtgtcctct

SEQ ID NO: 564 - DNA, 726 bp, Artificial Sequence
  Single Chain Variable Fragment (scFv)
gacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagggcggaggcggaagtggaggcggaggatctggcggcggaggctctcaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgct

SEQ ID NO: 565 - DNA, 723 bp, Artificial Sequence
  Single Chain Variable Fragment (scFv)
gacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagaggcggaggcggaagtggaggcggaggatctggcggcggaggctctcaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagt

SEQ ID NO: 566 - DNA, 726 bp, Artificial Sequence
  Single Chain Variable Fragment (scFv)
gacatcgtgctgacccagagccccgccagcctggccgtgagcctgggccagagcgtgaccatcagctgcagagccagcgagagcgtggagtactacggcaccagcctgatgcagtggtaccagcagaagcccggccagccccccaagctgctgatctacgccaccagcaacgtggagagcggcgtgcccgccagattcagcggcagcggcagcggcaccgacttcagcctgaacatccaccccgtggaggaggacgacatcgccatgtacttctgccagcagagcagaaagctgcccagcaccttcggcggcggcaccaagctggagatcaagggcggaggcggaagtggaggcggaggatctggcggcggaggctctgacgtgagactgcaggagagcggccccggccaggtgaagcccagccagaccgtgagcctgacctgcagcgtgaccggctacagcatcaccaacggcaaccactggtggaactggatcagacaggtgagcggcagcaagctggagtggatcggctacatcagcagcagcggcagcaccgacagcaaccccagcctgaagagcagaatcagcatcaccagagacaccagcaagaaccagctgttcctgcagctgaacagcgtgaccaccgaggacatcgccacctactactgcgccagaggctactacttcgactactggggccagggcaccaccctgaccgtgagcagc

SEQ ID NO: 567 - DNA, 723 bp, Artificial Sequence
  Single Chain Variable Fragment (scFv)
gaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctggcggaggcggaagtggaggcggaggatctggcggcggaggctctgaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctct

SEQ ID NO: 568 - DNA, 747 bp, Artificial Sequence
  Single Chain Variable Fragment (scFv)
gacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctggcggaggcggaagtggaggcggaggatctggcggcggaggctctcaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggaccc

SEQ ID NO: 569 - DNA, 765 bp, Artificial Sequence
  Single Chain Variable Fragment (scFv)
cagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgggcggaggcggaagtggaggcggaggatctggcggcggaggctctcagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagc

SEQ ID NO: 570 - DNA, 720 bp, Artificial Sequence
  Single Chain Variable Fragment (scFv)
gagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagaggcggaggcggaagtggaggcggaggatctggcggcggaggctctcaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagc

SEQ ID NO: 571 - DNA, 750 bp, Artificial Sequence
  Single Chain Variable Fragment (scFv)
gagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcggcggaggcggaagtggaggcggaggatctggcggcggaggctctctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctca

SEQ ID NO: 572 - DNA, 735 bp, Artificial Sequence
  Single Chain Variable Fragment (scFv)
gacatcgtgatgacccagagccaggacagcatggctaccagcgtgggcgagcgcgtgaccgtgaattgcaaggccagccagaacgtggacaccaacgtggcctggtatcagcagaagcccggccagtctcctgagcccctgctgttcagcgccagctacagatacaccggcgtgcccgacagattcagcggcagcggctctggcaccgacttcaccctgacaatcagcagcgtgcaggccgaggacgtggccgagtatttctgccagcagtacaacagctaccccctgaccttcggccagggcaccaagctggaaatcaagagaggcggaggcggaagtggaggcggaggatctggcggcggaggctctgaagtgcaggtggaagtgtctggcggcggactggtgcagcctggcggatctatgagactgagctgtgccgtgtccggcttcaccttcagcaactactggatgaactgggtgcgccagtcccccgagaagggcctggaatggatcgccgagatccggctgaagtccaacaacttcgcccggtactacgccgagagcgtgaagggcagattcaccatcagccgggacaacagcaagaacagcctgtacctccagatgatctccctgagagccgaggacaccgccatctactactgcaccagctacggcaactacgtgggccactacttcgaccactggggccagggaacactgctgaccgtgtctagc

SEQ ID NO: 573 - DNA, 756 bp, Artificial Sequence
  Single Chain Variable Fragment (scFv)
gagatcgtgctgacccagagccctctgagcctgcctgtgacacctggcgagcctgccagcatctcctgtagaagcagccagagcctgctgcacagcaacggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagaccccccggacctttggacagggcaccaaggtggaaatcaagcggggcggaggcggaagtggaggcggaggatctggcggcggaggctctcaggtgcaactggtgcagtctggcggcggagtggtgcagcctggaagaagcctgagactgagctgtgccgccagcggcttcaccttcagcagctacggaatgcactgggtgcgccaggcccctggcaaaggactggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgcgccagagacttcgactacggcgacagctactactactatggcatggacgtgtggggccagggcacaaccgtgaccgtgtcatct

SEQ ID NO: 574 - DNA, 738 bp, Artificial Sequence
  Single Chain Variable Fragment (scFv)
gagatcgtgctgacacagagccctgccaccctgtctctgagccctggcgaaagagccaccctgagctgtagagccagccagagcgtgggcagctacctggcctggtatcagcagaagcctggcgctccccggctgctgatctacgatgcctctcacagagccaccggcatccccgccagattttctggcagcggctccggcaccgacttcaccctgacaatcagctccctggaacccgaggacttcgccgtgtactactgccagcagcggagcaactggccccccatgtataccttcggccagggcaccaagctggaaatcaagagaggcggaggcggaagtggaggcggaggatctggcggcggaggctctgaagtgcagctggtgcagtctggcgctgaggtgtccgtgaaggtgtcctgcaaagccagcggcggcaagaagcccggcagcacctttagcagctacaccatcagctgggtgcgccaggcacctggacagggcctggaatggatgggcggcatcatccccatcttcggcaccgccaactacgcccagaaattccagggcagagtgaccatcaccgccgacaagagcaccagcaccgcctacatggaactgagcagcctgcggagcgaggacacagccgtgtattattgtgccggcgacaccgacagcagcggctactatggcgctgtggactattggggccagggaaccctcgtgaccgtgtcctct

SEQ ID NO: 575 - DNA, 690 bp, Artificial Sequence
  Single Chain Variable Fragment (scFv)
gacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaaggcggaggcggaagtggaggcggaggatctggcggcggaggctctgaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagc

SEQ ID NO: 576 - DNA, 720 bp, Artificial Sequence
  Single Chain Variable Fragment (scFv)
gacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctct

SEQ ID NO: 577 - DNA, 732 bp, Artificial Sequence
  Single Chain Variable Fragment (scFv)
gacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatct

SEQ ID NO: 578 - DNA, 750 bp, Artificial Sequence
  Single Chain Variable Fragment (scFv)
gacatcgtgatgacccagagccccagcagcctgaccatgagcgtgggccagaaagtgaccatgtcctgcaagagcagccacagcctgctgaacagccggaaccagaagaactacctggcctggttccagcagaagcccggccagtcccccaagctgctggtgtacttcgcaagcacccgcgagagcggcgtgcccgacagattcatcggcagcggctccggcaccgacttcaccctgaccatcagcaacgtgcaggccgaggacctggccgactacttctgccagcagcactacaccaccctgcccaccttcggcggaggcaccaagctggaaatcaagggcggaggcggaagtggaggcggaggatctggcggcggaggctctcagatccagctggtgcagagcggccctgacctgaagaaacccggcgagacagtgaagatcagttgcaaggcctccggctacaccttcaccaacacaggcatgaactgggtcaagcaggcccctggcaagggcctgaagtggatgggctggatcaacacctacaccggcgagcccacctacgccgacgacttcaagggccggttcaccttcagcctggaaaccagcgccagcaccgcctacctgcagatcaacaacctgaagaacgaggacaccgccacctatttctgcaccagatggggctacggcagcagcctgtactacgccatggactactggggccagggcaccagcgtgaccgtgtcctct

SEQ ID NO: 579 - DNA, 720 bp, Artificial Sequence
  Single Chain Variable Fragment (scFv)
gacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagaggcggaggcggaagtggaggcggaggatctggcggcggaggctctcaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctct

SEQ ID NO: 580 - DNA, 723 bp, Artificial Sequence
  Single Chain Variable Fragment (scFv)
gacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagggcggaggcggaagtggaggcggaggatctggcggcggaggctctcaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatct

SEQ ID NO: 581 - DNA, 735 bp, Artificial Sequence
  Single Chain Variable Fragment (scFv)
gacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccggcggaggcggaagtggaggcggaggatctggcggcggaggctctgaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagt

SEQ ID NO: 582 - DNA, 720 bp, Artificial Sequence
  Single Chain Variable Fragment (scFv)
gacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagaggcggaggcggaagtggaggcggaggatctggcggcggaggctctgaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctct

SEQ ID NO: 583 - DNA, 723 bp, Artificial Sequence
  Single Chain Variable Fragment (scFv)
gacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagcc

SEQ ID NO: 584 - DNA, 747 bp, Artificial Sequence
  Single Chain Variable Fragment (scFv)
gacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctca

SEQ ID NO: 585 - DNA, 732 bp, Artificial Sequence
  Single Chain Variable Fragment (scFv)
gacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttca

SEQ ID NO: 586 - DNA, 753 bp, Artificial Sequence
  Single Chain Variable Fragment (scFv)
gaccagagcgtgctgacacagcctccatccgtgtctggcgctccaggccagagagtgaccatctcctgtaccggcagcagcagcaacatcggagccggctatgacgtgcactggtatcagcaactgcccggcaccgcccccaagctgctgatctacggcaacagcaacagacccagcggcgtgcccgatagattcagcggcagcaagagcggcacaagcgccagcctggctatcactggactccaggccgaggacgaggccgactactactgccagagctacgacaacagcctgtcctcctgggtgttcggcggaggcaccaagctgacagtgctgggccagcctaagggcggaggcggaagtggaggcggaggatctggcggcggaggctctgaagtgcaactccagcagagcggagccgaagtgaagaaacccggcagctccgtgaaggtgtcctgcaaggcttccggcggcaccttcagcagctacgccatttcttgggtgcgccaggcccctggacagggcctggaatggatgggcagaatcatccccatcctgggaatcgccaactacgcccagaaattccagggccgcgtgaccatcaccgccgacaagagcacaagcaccgcctacatggaactgagcagcctgcggagcgaggacaccgccgtgtactactgcgccagagatgtgggcagcggctcctacagcctggactattggggccagggcaccctcgtgaccgtgtctagt

SEQ ID NO: 587 - DNA, 744 bp, Artificial Sequence
  Single Chain Variable Fragment (scFv)
gaccagagcgtcgtgacacagcctccatctgtgtctgccgcccctggccggaaagtgaccatctcttgtagcggcagcagcagcaacatcggcagcaactacgtgtcctggtatcagcaggtgcccggcaccgcccctaagctgctgatctacgaggacgacaagcggcccagcggcatccccgatagattcagcggctctaagagcggcaccagcgccacactgggcatcaccggactccagacaggcgacgaggccgactacttctgcgccacctgggacagaaccgtgaacgtggtgcgctttggcggcggaaccagactgacagtgcacagccagcctaagggcggaggcggaagtggaggcggaggatctggcggcggaggctctcaactccaactccaggaaagcggccctggcctcgtgaagcctagcgagacactgagcctgacctgcaccgtgtctggcggcagcatctccagcagctcctactactggggctggatcagacagccccctggcaagggcctggaatggatcggctccatctactacagcggaagcacctactacaaccccagcctgaagtcccgcgtgaccatcagcgtggacaccagcaagaaccagttctccctgaagctgagcagcgtgacagccgccgataccgccgtgtactactgtgccagacatgtgggccacgagctggattactggggccagggcacactcgtgaccgtgtctagt

SEQ ID NO: 588 - DNA, 726 bp, Artificial Sequence
  Single Chain Variable Fragment (scFv)
gacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagaggcggcggaggctcaggcggaggcggatctggcgggggaggatctcaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctct

SEQ ID NO: 589 - DNA, 726 bp, Artificial Sequence
  Single Chain Variable Fragment (scFv)
gaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaaggcggaggcggaagtggaggcggaggatctggcggcggaggctctgaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctct

SEQ ID NO: 590 - DNA, 720 bp, Artificial Sequence
  Single Chain Variable Fragment (scFv)
gacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagc

SEQ ID NO: 591 - DNA, 720 bp, Artificial Sequence
  Single Chain Variable Fragment (scFv)
gatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaac

SEQ ID NO: 592 - DNA, 723 bp, Artificial Sequence
  Single Chain Variable Fragment (scFv)
gacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagaggcggaggcggaagtggaggcggaggatctggcggcggaggctctgatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctct

SEQ ID NO: 593 - DNA, 726 bp, Artificial Sequence
  Single Chain Variable Fragment (scFv)
gacatcgtaatgacccaggctgccccatccataccagtcactcccggtgaatccgtgtctatatcttgtaggtccgataagagtctgcttcacagcaacggcaatacttatcttttctggtttttgcagcgaccgggacaaagcccacaactgctgatctatagaatgtcaaatcttgcatcaggggtcccagatcgctttagtggatctgggtcaggcacagctttcaccctgagaatctccggagtggaagcagaagacgtaggcgtgtattactgtatgcagcaccttgagtatccttatacctttggaggcggaactaagctcgaaattaaaggcggaggcggaagtggaggcggaggatctggcggcggaggctctcaggttcaactgcagcagtctggacctgaactggtgaagcctggggcctcagtgaagatgtcctgcaaggcttctggctacgcattcagtagttcctggttgaactgggtgaggcagaggcctggaaagggtcttgagtggattggacggatttatcctggagatggagaaaatcactataatgggaaattcaagggcaaggccacactgactgcagacaaatcctccagcacaggctacatgcaactcagcagcctgacgtctgaggactctgcggtctacttctgtgcaagttattatgaagggggttattggggccaagggactctaatcactgtctctgca

SEQ ID NO: 594 - DNA, 723 bp, Artificial Sequence
  Single Chain Variable Fragment (scFv)
gacatcgtactgacacagagccccgcttctctggcagtgtcactgggccagtccgttacaatatcctgtcgggcgagtgaatccgtggaatactatggaacaagtctcatgcagtggtatcagcagaaacctggacagccccccaagctgctcatctacggtgcgtcaaatgtcgagagtggggttccggcccgattcagtggttccgggagtggcacagactttagcctcaacatccatcctgttgaggaagacgatattgccatgtatttttgccaacagtcccgcaaagtcccctggacctttggtggaggaactaagctggagatcaagggcggaggcggaagtggaggcggaggatctggcggcggaggctctgaggtcaagctggtagagagtggaggtgggctggttaaaccaggggggagcagaaaactgagttgtgccgcaagtggcttcaccttttctagctataccatgagctgggtaagacaaactccagcaaagcgccttgagtgggtcgcaacaattagcagcggatcttctactatttattacgctgacactgttaagggccggtttaccatatcaagagacaacgccaagaatacccttttccttcaaatgacttcactgcggtccgaggatacggcaatgtactattgtgcacgacggtggtttctcgactgctggggccaggggactacccttaccgtgtctagt

SEQ ID NO: 595 - DNA, 732 bp, Artificial Sequence
  Single Chain Variable Fragment (scFv)
gaccaggtgcagctgcagcagtcgggcccaggactggtgaagccttcggagaccctgtccctcacctgcactgtctctggtgactccatcagtagttactactggagctggatcaggcagcccccagggaagggactggagtggattgggtatatctattacagtgggagcaccaactacaacccctccctcaagagtcgagtcaccatatcagtagacacgtccaagagccagttctccctgaagctgagctctgtgaccgccgcagacacggccgtgtattactgtgcgcgcggcaggtacttcgatgtctggggacgaggcactatggtgactagcagcggcggaggcggaagtggaggcggaggatctggcggcggaggctcttcctcctacgtgctgactcagcctccctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcacccgagttttcggcggagggaccaagctgaccgtcctaggtgccgccgca

SEQ ID NO: 596 - DNA, 735 bp, Artificial Sequence
  Single Chain Variable Fragment (scFv)
gacatcgtaatgacacagtctcccctgtccctccctgtcacaccaggtgaacctgccagtatttcttgtagatccagtaagtcacttctgcactccaatgggaacacctacctgtattggttccagcaaaagcctggtcaggcacctcgcttgcttatttataggatgtccaatcttgcatccggcgtgccagaccgattctcaggctccggctctggtactgcatttaccctgaaaatctcccgcgtggaagcagaagatgtgggcgtgtactactgtatgcagcacatcgagtaccccttcacgtttggtcaaggcacaaagctggaaatcaaaggcggaggcggaagtggaggcggaggatctggcggcggaggctctcaggtccagctcgtccagtctggacccgaagtcaagaagccaggcgcctctgtgaaggtttcttgtaaggccagcggatatacattcactaattcatggatgaactgggtgaggcagcgccctggcaaggggcttgagtggatcgggcggatttacccaggggatggcgagacaatttacaacgggaaatttcgggtgagagtgacgatcaccgcagacgaatctacaagcacggcctacatggagttgtcctctctcaggagtgaggacaccgccgtctactattgtgctagaggttatgacgactattcattcgcatactggggccagggcaccaccgtcacagtatcatct

SEQ ID NO: 597 - DNA, 732 bp, Artificial Sequence
  Single Chain Variable Fragment (scFv)
gagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggggcggaggcggaagtggaggcggaggatctggcggcggaggctctgaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatct

SEQ ID NO: 598 - DNA, 741 bp, Artificial Sequence
  Single Chain Variable Fragment (scFv)
gagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagaggcggaggcggaagtggaggcggaggatctggcggcggaggctctgaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagc

SEQ ID NO: 599 - DNA, 750 bp, Artificial Sequence
  Single Chain Variable Fragment (scFv)
gacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagaggcggaggcggaagtggaggcggaggatctggcggcggaggctctgtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagt

SEQ ID NO: 600 - DNA, 747 bp, Artificial Sequence
  Single Chain Variable Fragment (scFv)
gacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcggcggaggcggaagtggaggcggaggatctggcggcggaggctctcaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagt

SEQ ID NO: 601 - DNA, 717 bp, Artificial Sequence
  Single Chain Variable Fragment (scFv)
gagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagaggcggaggcggaagtggaggcggaggatctggcggcggaggctctcaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagc

SEQ ID NO: 602 - DNA, 723 bp, Artificial Sequence
  Single Chain Variable Fragment (scFv)
gacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagggcggaggcggaagtggaggcggaggatctggcggcggaggctctgtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctct

SEQ ID NO: 603 - DNA, 735 bp, Artificial Sequence
  Single Chain Variable Fragment (scFv)
gaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctttcgaagtgcagctgctggaatctggcggcggactggtgcagcctggcggatctctgagactgagctgtgccgcctccggcttcaccttcagcacctaccagatgagctgggtgcgccaggcccctggcaaaggactggaatgggtgtccgggatcgtgtccagcggcggctctacagcctacgccgatagcgtgaagggccggttcaccatcagccgggacaacagcaagaacaccctgtacctgcagatgaacagcctgagagccgaggacaccgccgtgtactattgtgccggcgagctgctgccctactacggcatggatgtgtggggccagggcaccaccgtgaccgtgtcatct

SEQ ID NO: 604 - DNA, 732 bp, Artificial Sequence
  Single Chain Variable Fragment (scFv)
gaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctgaagtgcagctgctggaatctggcggcggactggtgcagcctggcggatctctgagactgagctgtgccgccagcggcttcaccttcagcacctacgagatgcactgggtgcgccaggcccctggcaaaggactggaatgggtgtccgtgatcctgagcagcggcggagagacaaactacgccgacagcgtgaagggccggttcaccatcagccgggacaacagcaagaacaccctgtacctccagatgaacagcctgcgggccgaggacaccgccgtgtactattgtgccggaatgctgctgccctactacggcatggatgtgtggggccagggcaccaccgtgaccgtgtcatct

SEQ ID NO: 605 - DNA, 723 bp, Artificial Sequence
  Single Chain Variable Fragment (scFv)
gacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatct

SEQ ID NO: 606 - DNA, 726 bp, Artificial Sequence
  Single Chain Variable Fragment (scFv)
gccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagaggcggaggcggaagtggaggcggaggatctggcggcggaggctctcaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagt

SEQ ID NO: 607 - DNA, 720 bp, Artificial Sequence
  Single Chain Variable Fragment (scFv)
gacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttct

SEQ ID NO: 608 - DNA, 774 bp, Artificial Sequence
  Single Chain Variable Fragment (scFv)
gacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagaggcggaggcggaagtggaggcggaggatctggcggcggaggctctggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagt

SEQ ID NO: 609 - DNA, 765 bp, Artificial Sequence
  Single Chain Variable Fragment (scFv)
cagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggggcggaggcggaagtggaggcggaggatctggcggcggaggctctgtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatct

SEQ ID NO: 610 - DNA, 690 bp, Artificial Sequence
  Single Chain Variable Fragment (scFv)
gacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagggcggaggcggaagtggaggcggaggatctggcggcggaggctctgaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttct

SEQ ID NO: 611 - DNA, 735 bp, Artificial Sequence
  Single Chain Variable Fragment (scFv)
gacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagggcggaggcggaagtggaggcggaggatctggcggcggaggctctcaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatct

SEQ ID NO: 612 - DNA, 711 bp, Artificial Sequence
  Single Chain Variable Fragment (scFv)
gacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagggcggaggcggaagtggaggcggaggatctggcggcggaggctctgaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagt

SEQ ID NO: 613 - DNA, 714 bp, Artificial Sequence
  Single Chain Variable Fragment (scFv)
gacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatct

SEQ ID NO: 614 - DNA, 714 bp, Artificial Sequence
  Single Chain Variable Fragment (scFv)
gacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagaggcggaggcggaagtggaggcggaggatctggcggcggaggctctcaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgct

SEQ ID NO: 615 - DNA, 723 bp, Artificial Sequence
  Single Chain Variable Fragment (scFv)
gacatcaagatgacccagagccccagctctatgtacgccagcctgggcgagcgcgtgaccatcacctgtaaagccagccccgacatcaacagctacctgagctggttccagcagaagcccggcaagagccccaagaccctgatctaccgggccaacagactggtggatggcgtgcccagcagattctctggcggcggaagcggccaggactacagcctgaccatcaactccctggaatacgaggacatgggcatctactactgcctccagtacgacgagttcccctacaccttcggcggaggcaccaagctggaaatgaaaggcggaggcggaagtggaggcggaggatctggcggcggaggctctgaagtgaagctggtggaatcaggaggaggcctcgtgaaacctggcggctctctgaagctgagctgtgccgccagcggcttcaccttcagcagctacgccatgagctgggtgcgccagattcccgagaagcggctggaatgggtggcctccattagcagaggcggcaccacctactaccccgacagcgtgaagggccggttcaccatctccagagacaacgtgcggaacatcctgtacctccagatgagcagcctgcggagcgaggacaccgccatgtactactgcggcagatacgactacgacggctactacgctatggactactggggccagggcaccagcgtgaccgtgtcatct

SEQ ID NO: 616 - DNA, 729 bp, Artificial Sequence
  Single Chain Variable Fragment (scFv)
gacgtggtcgtgacccctgtgtcctgcttcctgagctgcatctctggcgccgagggccaccacctgattcagggccagcagaagtgccagtacatctggctgctgtacgccctggaacccaccgagacaagaaccgccacccagacccctcacctgtcctgcatccagcccagaatctggggaccctgccaggtgcagtggcagtgggtgtgggatagactgcacccccagcaccctagttgtggcggcggaggctgttgcaacctgctgctgtctgcccacggcgcctacacatttggcggaggcacccggctggaactgaaaggcggaggcggaagtggaggcggaggatctggcggcggaggctctgaagtgaagctccaggaaagcggccctgagctcgtgaagcctggcgcctctgtgaagatgagctgcaaggccagcggctacaccttcaccagctacgtgatgcactgggtcaagcagaagcccggccagggcctggaatggatcggctacatcaacccctacaacgacggcaccaagtacaacgagaagttcaagggcaaggccaccctgaccagcgacaagagcagcagcaccgcctacatggaactgagcagcctgacctccgaggacagcgccgtgtactactgcgcccggtggaaaatctactacggcaactacgaggactactggggccagggcacacccctgacagtgtctagt

SEQ ID NO: 617 - DNA, 822 bp, Artificial Sequence
  Single Chain Variable Fragment (scFv)
gacgaattccaggtgcaactggtgcagtctggcggagggctggtgcagccagggggatctctgagactgagctgtgccgccagcgacttcgacttcgccgcctacgagatgagctgggtgcgccaggctcctggacagggactggaatgggtggccatcatcagccacgacggcatcgacaagtattacaccgacagcgtgaagggccggttcaccatcagccgggacaacagcaagaacaccctgtacctgcagatgaataccctgcgggccgaggacaccgccacctactattgcctgagactgggagccgtgggccagggcacacttgtgacagtgtctagcctcgagggaggaggcggctccgggggaggcggaagtggaggcggaggatctgggtctggaggaagcggatctggaggctcagggtcagggggctcaggcagtggaggcagcttcgaacaggtgcaactggtgcagagcggaggcggactggtgcagcctgggggcagtctgaggctgtcttgtgccgcctccgatttcgccttcgatgattacgagatgtcttgggtgcggcaggccccaggcaaagccctggaatggatcggcgacatcaaccacagcggcaccaccatctacaaccccagcctgaagtccagagtgaccatctccagagacaactccaagaatactctgtacctgcagatgaacacactgagagccgaagatacagccatctactactgcgccagaccccactacggcgactacagcgacgccttcgacatctggggccagggaaccatggtcaccgtgtcctct

SEQ ID NO: 618 - DNA, 747 bp, Artificial Sequence
  Single Chain Variable Fragment (scFv)
gagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagggcggaggcggaagtggaggcggaggatctggcggcggaggctctcaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagt

SEQ ID NO: 619 - DNA, 735 bp, Artificial Sequence
  Single Chain Variable Fragment (scFv)
cagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgggcggaggcggaagtggaggcggaggatctggcggcggaggctctcaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagt

SEQ ID NO: 620 - DNA, 720 bp, Artificial Sequence
  Single Chain Variable Fragment (scFv)
gagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaaggcggaggcggaagtggaggcggaggatctggcggcggaggctctcaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttct

SEQ ID NO: 621 - DNA, 729 bp, Artificial Sequence
  Single Chain Variable Fragment (scFv)
gacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagaggcggaggcggaagtggaggcggaggatctggcggcggaggctctcaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatct

SEQ ID NO: 622 - DNA, 756 bp, Artificial Sequence
  Single Chain Variable Fragment (scFv)
gacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggggcggaggcggaagtggaggcggaggatctggcggcggaggctctgaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctct

SEQ ID NO: 623 - DNA, 729 bp, Artificial Sequence
  Single Chain Variable Fragment (scFv)
agctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctct

SEQ ID NO: 624 - DNA, 738 bp, Artificial Sequence
  Single Chain Variable Fragment (scFv)
aacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctct

SEQ ID NO: 625 - DNA, 726 bp, Artificial Sequence
  Single Chain Variable Fragment (scFv)
gacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagaggcggaggcggaagtggaggcggaggatctggcggcggaggctctgaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgct

SEQ ID NO: 626 - DNA, 726 bp, Artificial Sequence
  Single Chain Variable Fragment (scFv)
gacatccagatgacccagagccccagcatcctgagcgccagcgtgggcgacagagtgaccatcacctgtcgggccagccagagattcggcgactacctggcctggtatcagcagaagcctggacaggcccccaagctgctgatctacggcgcttccacactccagagcggcgtgcccagcagattttctggcagcggctccggcaccgagttcaccctgacaatcagcggcctccagcccgaggacttcgccacctactattgccagcaggccaacagcttccctatcaccttcggcaagggcacccggctggacatcagaagaggcggaggcggaagtggaggcggaggatctggcggcggaggctctcaggtgcagctggtgcagtctggggccgaagtgaagaaacccggcagcagcgtgaaggtgtcctgcaaggcttccggcggcaccttcagcagctacgccatttcttgggtgcgccaggccccaggacagggcctggaatggatgggctggatcaacgtgggcaacggcaacgccatctacagccagaaattccagggccgcgtgacaatcaccagagacaccagcgccaccaccgcctacatggaactgagcagcctgcggagcgaggacaccgccgtgtactactgtgccagggatggcgagagagcctgggacctggattattggggccagggcacactcgtgaccgtgtcctct

SEQ ID NO: 627 - DNA, 741 bp, Artificial Sequence
  Single Chain Variable Fragment (scFv)
gagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctacacattcggccagggcaccaagctggaaatcaagagaggcggaggcggaagtggaggcggaggatctggcggcggaggctctcaggtgcaactggtgcagtctggcggcggagtggtgcagcctggaagaagcctgagactgtcctgtgccgccagcggcttcaccttcagcagctacgccatgcactgggtgcgccaggcccctggaaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacacagccgtgtattattgcgccagagagctgcggttcctggaatggtccagcgacgccttcgacatctggggccagggaacaatggtcaccgtgtcctcc

SEQ ID NO: 628 - DNA, 729 bp, Artificial Sequence
  Single Chain Variable Fragment (scFv)
gagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagggcggaggcggaagtggaggcggaggatctggcggcggaggctctcaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctct

SEQ ID NO: 629 - DNA, 756 bp, Artificial Sequence
  Single Chain Variable Fragment (scFv)
gacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagaggcggaggcggaagtggaggcggaggatctggcggcggaggctctcaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctct

SEQ ID NO: 630 - DNA, 726 bp, Artificial Sequence
  Single Chain Variable Fragment (scFv)
gagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagggcggaggcggaagtggaggcggaggatctggcggcggaggctctcaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatct

SEQ ID NO: 631 - DNA, 717 bp, Artificial Sequence
  Single Chain Variable Fragment (scFv)
gacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagaggcggaggcggaagtggaggcggaggatctggcggcggaggctctcaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagt

SEQ ID NO: 632 - DNA, 732 bp, Artificial Sequence
  Single Chain Variable Fragment (scFv)
gacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagggcggaggcggaagtggaggcggaggatctggcggcggaggctctcaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagc

SEQ ID NO: 633 - DNA, 729 bp, Artificial Sequence
  Single Chain Variable Fragment (scFv)
gacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagggcggaggcggaagtggaggcggaggatctggcggcggaggctctcagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatct

SEQ ID NO: 634 - DNA, 735 bp, Artificial Sequence
  Single Chain Variable Fragment (scFv)
gacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagggcggaggcggaagtggaggcggaggatctggcggcggaggctctcaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctct

SEQ ID NO: 635 - DNA, 723 bp, Artificial Sequence
  Single Chain Variable Fragment (scFv)
cagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgggcggaggcggaagtggaggcggaggatctggcggcggaggctctcaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctct

SEQ ID NO: 636 - DNA, 717 bp, Artificial Sequence
  Single Chain Variable Fragment (scFv)
gacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagggcggaggcggaagtggaggcggaggatctggcggcggaggctctgaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctct

SEQ ID NO: 637 - DNA, 750 bp, Artificial Sequence
  Single Chain Variable Fragment (scFv)
gccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagaggcggaggcggaagtggaggcggaggatctggcggcggaggctctgaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagt

SEQ ID NO: 638 - DNA, 735 bp, Artificial Sequence
  Single Chain Variable Fragment (scFv)
gacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggggcggaggcggaagtggaggcggaggatctggcggcggaggctctcaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagc

SEQ ID NO: 639 - DNA, 747 bp, Artificial Sequence
  Single Chain Variable Fragment (scFv)
gagatcgtgctgacccagagccctctgagcctgcctgtgacacctggcgagcctgccagcatctcctgtagaagcagccagagcctgctgcacagcatcggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccccctgacctttggcggaggcaccaaggtggaaatcaagcggggcggaggcggaagtggaggcggaggatctggcggcggaggctctgaagtgcaactggtggaaagcggaggcggcgtggtgcagcctggaagaagcctgagactgagctgtgccgccagcggcttcaccttccggtcctacggaatgcactgggtgcgccaggcccctggcaaaggactggaatgggtggccgtgatctcctacgacggctccaacaagtactacaccgacagcgtgaacggcagattcaccatcagcagagacaacagcaagaacaccctgtacctccagatgaacagcctgcgggccgaggacaccgccgtgtactattgtgctagaggcggaggctactacgagacaagcggccctgattactggggccagggcacactcgtgaccgtgtctagt

SEQ ID NO: 640 - DNA, 741 bp, Artificial Sequence
  Single Chain Variable Fragment (scFv)
gacgtcgtgatgacccagagccctctgagcctgcctgtgacacctggcgagcctgccagcatctcctgtagaagcagccagagcctgctgcacagcatcggctacaactacctgcactggtttctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccctcccacctttggacagggcaccagactggaaatcaagcggggcggaggcggaagtggaggcggaggatctggcggcggaggctctcaactccaactccaggaaagcggccctggcctcgtgaagcctagcggcacactgagcctgacatgtgccgtgtctggcggcagcatcagcagcagcaactggtggtcttgggtgcgccagcctcctggcaagggcctggaatggatcggcgaaatctaccacagcggcagcaccaactacaaccccagcctgaagtccagagtgaccatcagcgtggacaagagcaagaaccagttctccctgaagctgagcagcgtgacagccgccgataccgccgtgtactattgcgtgggcagcccctacggcgactacgtgctggattattggggccagggcaccctcgtgaccgtgtctagt

SEQ ID NO: 641 - DNA, 753 bp, Artificial Sequence
  Single Chain Variable Fragment (scFv)
gacgtcgtgatgacccagagccctctgagcctgcctgtgacacctggcgagcctgccagcatcagctgtagaagcagccagagcctgctgcacagcaacggccacaactacctggactggtatctccagaagcccggccagagcccccagctgctgatctacctgggcagcaatagagccagcggcgtgcccgatagattcagcggctctggaagcggcaccgacttcaccctgaagatcagccgggtggaagccgaggacgtgggcgtgtactactgtatgcagaccctccagacccccctgacctttggccctggcaccaaggtggacatcaagagaggcggaggcggaagtggaggcggaggatctggcggcggaggctctgaagtgcagctggtggaaacaggcggaggcgtggtgcagcctggcagaagcctgagactgagctgtgccgccagcggcttcaccttcagcagctacggaatgcactgggtgcgccaggcccctggcaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacaccgccgtgtactattgcgccaaggacagatacggctggggcagcagcttcggccacttcgattattggggccagggcaccctcgtgaccgtgtctagt

SEQ ID NO: 642 - DNA, 735 bp, Artificial Sequence
  Single Chain Variable Fragment (scFv)
gagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagggcggaggcggaagtggaggcggaggatctggcggcggaggctctcaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagt

SEQ ID NO: 643 - DNA, 735 bp, Artificial Sequence
  Single Chain Variable Fragment (scFv)
cagaccgtcgtgacacagcctcctagcgcctctggcacaccaggccagagagtgaccatctcctgtagcggcagcagcagcaacatcggcagcaactacgtgtactggtatcagcaactgcccggcaccgcccccaagctgctgatctacagaagcaaccagcggcccagcggcgtgcccgatagattttctggcagcaagagcggcaccagcgccagcctggctatctctggacctagaagcgtggacgaggccgactactactgcgccgcctgggacgatagcctgaacggcgtggtgtttggcggaggcaccaagctgacagtgctgggtggcggaggcggaagtggaggcggaggatctggcggcggaggctctcaggtgcaactggtgcagtctggggccgaagtgaagaaacccggcagctccgtgaaggtgtcctgcaaggcttccggcggcaccttcagcagctacgccatttcttgggtgcgccaggcccctggacagggcctggaatggatgggcggcatcatccccatctttggcaccgccaactacgcccagaaattccagggccgcgtgaccatcaccgccgacgagtctacaagcaccgcctacatggaactgagcagcctgcggagcgaggataccgccgtgtactactgtgccagaagaatccccccctactacggcatggacgtgtggggccagggaaccaccgtgaccgtgtcatct

SEQ ID NO: 644 - DNA, 735 bp, Artificial Sequence
  Single Chain Variable Fragment (scFv)
cagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtggcggaggcggaagtggaggcggaggatctggcggcggaggctctgaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctct

SEQ ID NO: 645 - DNA, 738 bp, Artificial Sequence
  Single Chain Variable Fragment (scFv)
caggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgggcggaggcggaagtggaggcggaggatctggcggcggaggctctcagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagc

SEQ ID NO: 646 - DNA, 720 bp, Artificial Sequence
  Single Chain Variable Fragment (scFv)
gacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagaggcggaggcggaagtggaggcggaggatctggcggcggaggctctcaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagt

SEQ ID NO: 647 - DNA, 732 bp, Artificial Sequence
  Single Chain Variable Fragment (scFv)
gacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttct

SEQ ID NO: 648 - DNA, 726 bp, Artificial Sequence
  Single Chain Variable Fragment (scFv)
gagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagaggcggaggcggaagtggaggcggaggatctggcggcggaggctctcaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagt

SEQ ID NO: 649 - DNA, 723 bp, Artificial Sequence
  Single Chain Variable Fragment (scFv)
gagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaaggcggaggcggaagtggaggcggaggatctggcggcggaggctctgaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctct

SEQ ID NO: 650 - DNA, 729 bp, Artificial Sequence
  Single Chain Variable Fragment (scFv)
gacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaaggcggaggcggaagtggaggcggaggatctggcggcggaggctctcaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttct

SEQ ID NO: 651 - DNA, 702 bp, Artificial Sequence
  Single Chain Variable Fragment (scFv)
gacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaaggcggaggcggaagtggaggcggaggatctggcggcggaggctctgaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatct

SEQ ID NO: 652 - DNA, 711 bp, Artificial Sequence
  Single Chain Variable Fragment (scFv)
gacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatct

SEQ ID NO: 653 - DNA, 732 bp, Artificial Sequence
  Single Chain Variable Fragment (scFv)
gacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagaggcggaggcggaagtggaggcggaggatctggcggcggaggctctgaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttct

SEQ ID NO: 654 - DNA, 744 bp, Artificial Sequence
  Single Chain Variable Fragment (scFv)
gacatccagctcacacagagcccttctagcctgtctgccagcgtgggcgacagagtgaccatcacatgtagagccagccagagcgtggactacgacggcgacagctacatgaactggtatcagcagaagcccggcaaggcccctaagctgctgatctacgccgccagctatctggaaagcggcgtgccaagcagattttccggctctggcagcggcaccgatttcaccctgacaatatccagcctccagcctgaggacttcgccacctactactgccagcagagccatgaggacccctacacctttggacagggcaccaaggtggaaatcaagagaggcggaggcggaagtggaggcggaggatctggcggcggaggctctgaagtgcaactggttgaatctggcggcggactggttcagcctggcggatctctgagactgagctgtgccgtgtctggctacagcatcaccagcggctactcttggaactggatcagacaggcccctggcaaaggactggaatgggtcgcctccatcacctacgatggcagcaccaactacaaccccagcgtgaagggcagaatcaccatcagcagggacgacagcaagaacaccttctacctgcaaatgaacagcctgagagccgaggacaccgccgtgtactattgtgccagaggcagccactacttcggccactggcattttgctgtgtggggccagggaaccctggtcacagtttcttct

SEQ ID NO: 655 - DNA, 720 bp, Artificial Sequence
  Single Chain Variable Fragment (scFv)
gacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaaggcggaggcggaagtggaggcggaggatctggcggcggaggctctgaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatct

SEQ ID NO: 656-700 - skipped (45 entries)

SEQ ID NO: 701 - DNA, 36 bp, Artificial Sequence
  Non-Cleavable Linker
gagcagaaactgatctcggaagaggatgggagcggc

SEQ ID NO: 702 - DNA, 36 bp, Artificial Sequence; identical to SEQ ID NO: 701
  Non-Cleavable Linker

SEQ ID NO: 703 - DNA, 39 bp, Artificial Sequence
  Non-Cleavable Linker
gagcagaaactgatctcggaagaggatctggggagcggc

SEQ ID NO: 704 - DNA, 39 bp, Artificial Sequence
  Non-Cleavable Linker
gaacagaaattgataagtgaggaagacttgggcagcggc

SEQ ID NO: 705 - DNA, 39 bp, Artificial Sequence; identical to SEQ ID NO: 703
  Non-Cleavable Linker

SEQ ID NO: 706 - DNA, 51 bp, Artificial Sequence
  Non-Cleavable Linker
gggaaaccaattcccaaccctcttctgggactggattcaaccggcagcggc

SEQ ID NO: 707 - DNA, 36 bp, Artificial Sequence
  Non-Cleavable Linker
tacccctacgatgtgcccgattacgctggcagcggc

SEQ ID NO: 708 - DNA, 27 bp, Artificial Sequence
  Non-Cleavable Linker
caccatcatcaccatcacggcagcggc

SEQ ID NO: 709 - DNA, 45 bp, Artificial Sequence
  Non-Cleavable Linker
ggcctgaacgacatcttcgaggctcagaagatcgaatggcacgag

SEQ ID NO: 710 - DNA, 39 bp, Artificial Sequence
  Non-Cleavable Linker
gggtctggaggcggaggcagcggcggaggcgggagcggc

SEQ ID NO: 711 - DNA, 39 bp, Artificial Sequence
  Non-Cleavable Linker
ggcagcggcggaggcggaagtggaggcggaggcagcggc

SEQ ID NO: 712 - DNA, 33 bp, Artificial Sequence
  Non-Cleavable Linker
tggtctcatccccagtttgaaaagggcagcggc

SEQ ID NO: 713 - DNA, 33 bp, Artificial Sequence
  Non-Cleavable Linker
tggtcccatccccagttcgagaaaggcagcggc

SEQ ID NO: 714 - DNA, 34 bp, Artificial Sequence
  Non-Cleavable Linker
gattataaagatgatgacgataaagggcagcggc

SEQ ID NO: 715 - DNA, 318 bp, Artificial Sequence
  IgCL
ggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagc

SEQ ID NO: 716 - DNA, 309 bp, Artificial Sequence
  IgG1-CH1
gcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgt

SEQ ID NO: 717 - DNA, 303 bp, Artificial Sequence
  IgG2-0C CHI
gcctcaacgaaagggcctagcgtcttccccctggcgccgtgctcacgatccacaagcgaatccaccgccgctctcggatgcctcgtaaaggattatttccctgaaccagtcacggtgtcatggaacagcggtgcccttaccagcggcgtccatacctttcctgctgtgctccagtccagcggactttatagtctcagctctgtcgtgaccgtcccttcctctaattttggcacccagacttacacgtgcaacgtcgatcataagcccagtaacaccaaggtagacaagacggtggaacgaaag

SEQ ID NO: 718 - DNA, 306 bp, Artificial Sequence
  IgG2-IC CHI
gcctccacgaagggaccatctgttttccctcttgccccctgctcacggtcaacgtctgaatccacggcagccctgggctgcctcgttaaggactactttccagagccggtaacagtctcctggaacagtggagcccttacatcaggtgttcacactttccctgccgtcttgcaaagtagcggactgtacagccttagttccgttgttacggttccttctagcaacttcggtacacagacatatacttgtaacgtagatcataagcctagcaacaccaaggtggacaaaaccgtagagagaaagtgt

SEQ ID NO: 719 - DNA, 309 bp, Artificial Sequence
  IgG3 CHI
gcaagtacaaagggacccagtgttttcccgctcgccccctgttcacgatcaacgagtgagtccactgcggctctcggatgcctcgtcaaagactacttccccgagccggtgactgttagttggaactctggggctcttacttcaggcgtacacacattccccgccgtgcttcagtcaagtgggctctactcacttagcagtgtggtaacggttccctctagcaactttggcacccaaacatatacttgcaacgtcgatcacaagccgtcaaataccaaagttgacaagaccgttgaaaggaaatgttgt

SEQ ID NO: 720 - DNA, 309 bp, Artificial Sequence
  IgG4 CHI
gcgtccactaagggtccgtcagtcttcccgctggcgccctgttcccgcagcacgagtgaatctaccgccgcccttgggtgcttggtaaaagactattttcctgagcccgttacagtatcatggaacagcggggctctgactagcggggtgcatacgttccctgcggttctgcaatctagcggactgtattctctctccagtgttgtgaccgtgccaagctccagcctcggtactaaaacttatacatgtaatgtggatcataaaccttcaaataccaaggttgacaaaagggtagagagtaagtacggt

SEQ ID NO: 721 - DNA, 363 bp, Artificial Sequence
  IgAI CHI
gcgtctcccacttctccgaaagttttccccctttccctctgtagcacacaacctgatggaaatgtggtcatcgcatgtctggtacaaggattctttccacaagagccattgagcgttacatggtcagagagcgggcagggagttaccgctaggaatttcccaccctcacaggatgcgagtggtgatctttataccacatcatcacaactcacgttgccagccactcagtgcctcgctggaaagtcagtaacatgccatgtcaaacattacactaatccctcacaagatgttaccgtgccttgcccagtaccttctacgccgcccaccccgtctccatctactccacccacgccatcacctagt

SEQ ID NO: 722 - DNA, 324 bp, Artificial Sequence
  IgA2 CHI
gcgtcacctacgtccccaaaagtgttcccgctgtcactcgattccactccacaggacggtaacgtggtggttgcctgcctggtacaaggtttctttcctcaagaaccactctctgtgacgtggtctgaaagtggtcagaatgttacagcacggaacttcccaccgagtcaagatgcgagtggggatctctatacgacatccagtcaactcacactgcccgcaacacaatgccccgatggcaaatctgttacctgccatgtgaaacattacaccaatccatcccaggatgtgacagtaccttgtccggttccgccccctcccccg

SEQ ID NO: 723 - DNA, 477 bp, Artificial Sequence
  IgD CHI
gctccgacaaaggcgccagacgtttttcctattatttcaggatgtcggcatccgaaagataattccccagttgttctggcgtgtcttatcacgggctaccatcctacatctgttaccgttacgtggtatatgggtacgcaaagccaacctcagcggacttttccagagatccaacggcgagattcatattatatgacatccagtcagttgagtacaccgctgcaacagtggcggcaaggtgagtataagtgtgtggtccaacacacagccagtaaaagtaagaaagagatattccggtggcctgaaagcccgaaggcacaagcatcttctgttccgacggcgcaaccgcaagctgaaggaagtcttgcaaaagcaaccacagcacccgcgacaacacgaaacacaggacgcggaggcgaggaaaagaaaaaagaaaaggaaaaggaagagcaagaggagagggaaactaagaccccc

SEQ ID NO: 724 - DNA, 309 bp, Artificial Sequence
  IgE CHI
gctagtacccagtcaccttctgttttcccgcttactagatgctgcaagaacataccatccaatgccacttctgtcacactgggctgtcttgctacaggttattttcctgagccggtgatggtcacttgggataccggtagcctgaatggaactacaatgacgctgcctgccacgacgctcacattgagtgggcattacgcgacaattagtcttttgacggtaagcggagcttgggctaagcagatgttcacttgcagagtagcgcacactccctctagtactgactgggttgacaacaaaaccttttct

SEQ ID NO: 725 - DNA, 312 bp, Artificial Sequence
  IgM CHI
gggtcagcaagtgcgcccacgctctttccattggtttcttgcgagaactctccctcagacacatcaagtgtcgcggtaggctgtctcgcccaagattttttgcccgatagtataacgctgtcatggaaatataagaacaatagtgatataagctccacaaggggttttccgagcgtactgcgaggcggtaaatatgcagcgacgagtcaagtcttgctcccatccaaggatgtcatgcaaggcaccgatgagcatgttgtttgcaaagtgcaacatccgaatggaaataaggaaaaaaacgtcccgctgccc

SEQ ID NO: 726-729 - skipped (4 entries)

SEQ ID NO: 730 - DNA, 423 bp, Homo sapiens
gatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagc

SEQ ID NO: 731 - DNA, 420 bp, Homo sapiens
atccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagc

SEQ ID NO: 732 - DNA, 420 bp, Artificial Sequence
  TCR Constant Chain
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 733 - DNA, 420 bp, Artificial Sequence
  TCR Constant Chain
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 734 - DNA, 411 bp, Artificial Sequence
  TCR Constant Chain
cctgatcctgccgtgtaccagctgcgggatagcaagagcagcgacaagagcgtgtgcctgttcaccgacttcgacagccagaccaacgtgtctcagtctaaggatagtgatgtgtatatcaccgacaagaccgtgctggacatgcggagcatggacttcaagagcaacagcgccgtggcctggtccaacaagagcgacttcgcctgcgccaacgccttcaacaacagcatcatccccgaggacaccttcttccccagccccgagagcagctgcgacgtgaaactggtggagaagagcttcgagacagacaccaacctgaacttccagaacctgagcgtgatcggcttcagaatcctgctgctgaaggtggccggcttcaacctgctgatgaccctgcggctgtggagcagc

SEQ ID NO: 735 - DNA, 420 bp, Artificial Sequence
  TCR Constant Chain
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 736 - DNA, 411 bp, Artificial Sequence
  TCR Constant Chain
cctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 737 - DNA, 420 bp, Artificial Sequence
  TCR Constant Chain
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 738 - DNA, 420 bp, Artificial Sequence
  TCR Constant Chain
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 739 - DNA, 420 bp, Artificial Sequence
  TCR Constant Chain
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 740 - DNA, 420 bp, Artificial Sequence
  TCR Constant Chain
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 741 - DNA, 717 bp, Artificial Sequence
  TCR Constant Chain
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 742 - DNA, 408 bp, Artificial Sequence
  TCR Constant Chain
atccagaaccctgaacctgccgtgtaccagctgaaggaccccagaagccaggacagcaccctgtgcctgttcaccgacttcgacagccagatcaacgtgcccaagacaatggaaagcggcaccttcatcaccgacaagaccgtgctggacatgaaggctatggacagcaagagcaacggcgccattgcctggtccaaccagaccagcttcacatgccaggacatcttcaaagagacaaacgccacctacccctccagcgacgtgccctgtgacgccaccctgaccgagaagtccttcgagacagacatgaacctcaacttccagaacctgagcgtgatgggcctgcgaatcctgctgctgaaagtggccggcttcaacctgctgatgaccctgcggctgtggtccagc

SEQ ID NO: 743 - DNA, 399 bp, Artificial Sequence
  TCR Constant Chain
gtgcaggaccctgaccctagcgtgtaccagatgagaagccccaagaccggcaggaccgtgtgcctgttcaccgacttcgacagccaggccgacttccagaagcctgagggggccaccgtgatctccctgaacagcaccgtgctggacatgaaagtgatggacagcaagagcaacggcgctctgacctggaacagcgagacaaacatcgagtgcaaagagaacttccagcagcccttctaccccagcagcaactactcctgcgacgccaagctgatcgagaagtccttcgagacagacatggacctgaacttctacaacctgctggtcatcggcctgagaatcctgctgctgaaagtgatcggcttcaacctgttcatgaccctgaggctgtggtcctgc

SEQ ID NO: 744 - DNA, 531 bp, Homo sapiens
gaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttc

SEQ ID NO: 745 - DNA, 537 bp, Homo sapiens
gaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 746 - DNA, 537 bp, Homo sapiens; identical to SEQ ID NO: 745

SEQ ID NO: 747 - DNA, 537 bp, Artificial Sequence
  TCR Constant Chain
gaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 748 - DNA, 537 bp, Artificial Sequence
  TCR Constant Chain
gaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 749 - DNA, 537 bp, Artificial Sequence
  TCR Constant Chain
gaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 750 - DNA, 534 bp, Artificial Sequence
  TCR Constant Chain
gacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 751 - DNA, 531 bp, Artificial Sequence
  TCR Constant Chain
gaggacctgaagaacgtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgagagctaccagcagggcgtgctgtctgccaccatcctgtacgagatcctgctgggcaaggccaccctgtacgccgtgctggtgtccgccctggtgctgatggctatggtgaagcggaaggacttc

SEQ ID NO: 752 - DNA, 531 bp, Artificial Sequence
  TCR Constant Chain
gaggacctgaacaaggtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgtgagctaccagcagggcgtgctgtctgccaccatcctgtacgagatcctgctgggcaaggccaccctgtacgccgtgctggtgtccgccctggtgctgatggctatggtgaagcggaaggacttc

SEQ ID NO: 753 - DNA, 537 bp, Artificial Sequence
  TCR Constant Chain
gaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 754 - DNA, 537 bp, Artificial Sequence
  TCR Constant Chain
gaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 755 - DNA, 537 bp, Artificial Sequence
  TCR Constant Chain
gaggacctgaagaacgtgttcccacctgaggtggccgtgttcgagcctagcaaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 756 - DNA, 537 bp, Artificial Sequence
  TCR Constant Chain
gaggacctgaagaacgtgttcccacctgaggtggccgtgttcgagcctagcaaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgccagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 757 - DNA, 537 bp, Artificial Sequence
  TCR Constant Chain
gaggacctgaagaacgtgttcccacctgaggtggccgtgttcgagcctagcaaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccaccagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 758 - DNA, 537 bp, Artificial Sequence
  TCR Constant Chain
gaggacctgaagaacgtgttcccacctgaggtggccgtgttcgagcctagcagggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 759 - DNA, 537 bp, Artificial Sequence
  TCR Constant Chain
gaggacctgaagaacgtgttcccacctgaggtggccgtgttcgagcctagcagggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 760 - DNA, 537 bp, Artificial Sequence
  TCR Constant Chain
gaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 761 - DNA, 537 bp, Artificial Sequence
  TCR Constant Chain
gaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 762 - DNA, 537 bp, Artificial Sequence
  TCR Constant Chain
gaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 763 - DNA, 513 bp, Artificial Sequence
  TCR Constant Chain
gaggatctgcggaacgtgaccccacccaaggtgtccctgttcgagcccagcaaggccgagatcgccaataaacagaaggccaccctcgtgtgcctggccagaggcttcttccccgaccacgtggaactgtcttggtgggtcaacggcaaagaggtgcacagcggcgtcagcaccgaccctcaggcctacaaagagagcaactacagctactgcctgagcagtcggctgcgggtgtccgccaccttctggcacaacccccggaaccacttcagatgccaggtgcagttccacggcctgagcgaagaggacaagtggcccgagggcagccccaagcctgtcacccagaacatcagcgccgaggcctggggcagagcctgtggcatcaccagcagctaccagcagggcgtgctgagcgccaccatcctgtacgagatcctgctgggcaaggccaccctgtacgccgtgctggtgtccaccctggtggtcatggctatggtcaagcggaagaacagc

SEQ ID NO: 764 - DNA, 531 bp, Artificial Sequence
  TCR Constant Chain
gaggacctccagaaagtgaccccccctaccgtgaccgtgttcgagccttctgaggccgagatcagccggacccagaaagccacactcgtgtgcctggctcggggcttctaccccgatcacgtggaactgtcttggtgggtcaacggcaaagaagtgaccagcggcttcagcaccgacccccagcctgacaaagagcggcccagcgagaacgacagcagctactgcctgagcagcagactgagagtgtccgccagcttctggcacaacccccggaaccacttcagatgccaggtgcagttctacggcctgggcgacgacgacgagtggaagtacgacagagtgaagcccatcacccagaacatcagcgccgaagcctggggcagagccgattgcggctttacctccgtcagctaccaccagggcgtgctgagcgccaccatcctgtacgagatcctgctgggcaaggccaccctgtacgccgtgctggtgtctatcctggtgctgatggctaaagtgaagcggaagggcagc

SEQ ID NO: 765 - DNA, 828 bp, Artificial Sequence
  TCR Constant Chain
gaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaaga

SEQ ID NO: 766 - DNA, 807 bp, Homo sapiens
  misc_feature (540)..(540): n is a, c, g, or t
gggtgtccagccctacccacaggtgtgggcggcacaccctttccttctctggccccaccaatcatgctgctggtggatggaaagcagcagatggtggtggtctgcctggtccttgatgttgcaccccctggccttgacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggntcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctcgcctcagggctccttcctccagtcttggagcattttttgcaggtgacctgcctcctcctctgcaggctggagctgcc

SEQ ID NO: 767 - DNA, 774 bp, Artificial Sequence
  TCR Constant Chain
accccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtgtggggcgagggcagctacctgagcagctaccctacatgccctgcccaggcttggtgcagcagaagcgcactgagagcacccagctctagcctgggagccttctttgccggcgatctgcctccaccactccaggctggcgctgct

SEQ ID NO: 768 - DNA, 630 bp, Artificial Sequence
  TCR Constant Chain
accccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 769 - DNA, 567 bp, Homo sapiens
gataaacaacttgatgcagatgtttcccccaagcccactatttttcttccttcaattgctgaaacaaaactccagaaggctggaacatacctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatcaagaaattatctttcctccaataaagacagatgtcaccacagtggatcccaaatacaattattcaaaggatgcaaatgatgtcatcacaatggatcccaaagacaattggtcaaaagatgcaaatgatacactactgctgcagctcacaaacacctctgcatattacatgtacctcctcctgctcctcaagagtgtggtctattttgccatcatcacctgctgtctgcttggaagaacggctttctgctgcaatggagagaaatca

SEQ ID NO: 770 - DNA, 519 bp, Artificial Sequence
  TCR Constant Chain
gacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtct

SEQ ID NO: 771 - DNA, 459 bp, Artificial Sequence
  TCR Constant Chain
agtcagcctcataccaaaccatccgtttttgtcatgaaaaatggaacaaatgtcgcttgtctggtgaaggaattctaccccaaggatataagaataaatctcgtgtcatccaagaagataacagagtttgatcctgctattgtcatctctcccagtgggaagtacaatgctgtcaagcttggtaaatatgaagattcaaattcagtgacatgttcagttcaacacgacaataaaactgtgcactccactgactttgaagtgaagacagattctacagatcacgtaaaaccaaaggaaactgaaaacacaaagcaaccttcaaagagctgccataaacccaaagccatagttcataccgagaaggtgaacatgatgtccctcacagtgcttgggctacgaatgctgtttgcaaagactgttgccgtcaattttctcttgactgccaagttatttttcttg

SEQ ID NO: 772 - DNA, 459 bp, Artificial Sequence
  TCR Constant Chain
agccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 773 - DNA, 321 bp, Artificial Sequence
  TCR Constant Chain
atccagaaccctgatcctgccgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 774 - DNA, 537 bp, Artificial Sequence
  TCR Constant Chain
gaggacctgaagaacgtgttcccacctgaggtggccgtgttcgagcctagcagggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 775 - DNA, 537 bp, Artificial Sequence
  TCR Constant Chain
gaggacctgaagaacgtgttcccacctgaggtggccgtgttcgagcctagcagggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 776-779 - skipped (4 entries)

SEQ ID NO: 780 - DNA, 65 bp, Artificial Sequence
  F2A
gtgaagcagaccctgaatttcgacctgctgaagctggctggcgacgtggaatccaacccaggccc

SEQ ID NO: 781 - DNA, 54 bp, Artificial Sequence
  T2A
gagggcagaggaagtctactaacctgcggagatgtggaagaaaatcctggccca

SEQ ID NO: 782 - DNA, 54 bp, Artificial Sequence
  T2A
gagggaagaggtagcctcctcacctgtggggacgttgaagagaaccccggccca

SEQ ID NO: 783 - DNA, 57 bp, Artificial Sequence
  P2A
gcaacaaacttctcactactcaaacaagcaggtgacgtggaggagaatcccgggcct

SEQ ID NO: 784 - DNA, 57 bp, Artificial Sequence
  P2A variant
gcaacaaacttctcactactcaaacaagcaggtgacgtggagcagaatcccgggcct

SEQ ID NO: 785 - DNA, 60 bp, Artificial Sequence
  E2A
caatgcactaattacgcattgctcaagctggccggtgacgttgagagtaatcctggcccc

SEQ ID NO: 786 - DNA, 12 bp, Artificial Sequence
  Ser-Gly-Ser-Gly (SGSG) Linker
tctggatctgga

SEQ ID NO: 787 - DNA, 12 bp, Artificial Sequence
  Ser-Gly-Ser-Gly (SGSG) Linker
agcggatctggc

SEQ ID NO: 788 - DNA, 12 bp, Artificial Sequence
  FURINE CLEAVAGE SITE
cgggccaagaga

SEQ ID NO: 789 - DNA, 12 bp, Artificial Sequence
  FURINE CLEAVAGE SITE
agggccaagcga

SEQ ID NO: 790 - DNA, 12 bp, Artificial Sequence
  FURINE CLEAVAGE SITE
cgcgccaagaga

SEQ ID NO: 791-794 - skipped (4 entries)

SEQ ID NO: 795 - DNA, 597 bp, Artificial Sequence
  Therapeutic Control/Accessory Module
atgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 796 - DNA, 396 bp, Artificial Sequence
  Therapeutic Control/Accessory Module
atggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggc

SEQ ID NO: 797 - DNA, 516 bp, Artificial Sequence
  Therapeutic Control/Accessory Module
atgggcaacgaggccagctaccctctggagatgtgctcccacttcgacgccgacgagatcaagcggctgggcaagcgcttcaagaagctggacctggacaacagcggcagcctgagcgtggaggagtttatgtctctgcccgagctgcagcagaaccccctggtgcagcgcgtgatcgacatcttcgacaccgacggcaacggcgaggtggacttcaaggagttcatcgagggcgtgagccagttcagcgtgaagggcgacaaggagcagaagctgcggttcgccttccgcatctacgatatggataaagatggctatatttctaatggcgagctgttccaggtgctgaagatgatggtgggcaacaataccaagctggccgatacccagctgcagcagatcgtggacaagaccatcatcaacgccgacaaggacggcgacggcagaatcagcttcgaggagttctgtgccgtggtgggaggcctggatattcacaaaaaaatggtggtggacgtg

SEQ ID NO: 798 - DNA, 1071 bp, Artificial Sequence
  Therapeutic Control/Accessory Module
atgctgctgctcgtgaccagcctgctgctgtgcgaactgccccaccctgcctttctgctgatcccccggaaagtgtgcaacggcatcggcatcggagagttcaaggacagcctgagcatcaacgccaccaacatcaagcacttcaagaactgcaccagcatcagcggcgacctgcacatcctgcccgtggcctttagaggcgacagcttcacccacacccccccactggaccctcaggaactggacatcctgaaaaccgtgaaagagatcaccggatttctgctgattcaggcttggcccgagaaccggaccgatctgcacgccttcgagaacctggaaatcatccggggcaggaccaagcagcacggccagttttctctggccgtggtgtccctgaacatcaccagcctgggcctgcggagcctgaaagaaatcagcgacggggatgtgattatcagcggcaacaagaacctgtgctacgccaacaccatcaactggaagaagctgttcggcacctccggccagaaaacaaagatcatcagcaaccggggcgagaacagctgcaaggccacaggacaagtgtgccacgccctgtgtagccctgagggctgttggggacccgagcccagagattgcgtgtcctgccggaatgtgtccagaggccgcgagtgcgtggacaagtgcaacctgctggaaggcgagccccgcgagtttgtggaaaacagcgagtgcatccagtgccaccccgagtgtctgccccaggccatgaatatcacctgtaccggcagaggccccgacaactgtatccagtgcgcccactacatcgacggcccccactgcgtgaaaacctgtccagctggcgtgatgggagagaacaacaccctcgtgtggaagtacgccgacgccggccatgtgtgccacctgtgtcaccccaactgcacctacggctgtacaggccctggcctggaaggctgccctaccaacggacccaagatccccagcattgccaccggcatggtgggagcattgctgctgctgctggtggtggccctgggcatcggcctgtttatg

SEQ ID NO: 799 - DNA, 1272 bp, Artificial Sequence
  Therapeutic Control/Accessory Module
atgcgaccctccgggacggccggggcagcgttcctggcgctgctggctgcgctctgcccggcgagtcgggctctggaggaaaagaaaggtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcct

SEQ ID NO: 800 - DNA, 999 bp, Artificial Sequence
  Therapeutic Control/Accessory Module
atgccccctcccagactgctgttcttcctgctgttcctgacccctatggaagtgcggcccgaggaacccctggtcgtgaaagtggaagagggcgacaacgccgtgctccagtgtctgaagggcacctccgatggccctacccagcagctgacatggtccagagagagccccctgaagcccttcctgaagctgtctctgggcctgcctggcctgggcatccacatgaggccactggctatctggctgttcatcttcaacgtgtcccagcagatgggcggcttctacctgtgtcagcctggccccccaagcgagaaagcctggcagcctggctggaccgtgaacgtggaaggatctggcgagctgttccggtggaacgtgtccgatctgggcggcctgggatgcggcctgaagaacagaagcagcgaaggccccagcagccccagcggcaaactgatgagccccaagctgtacgtgtgggccaaggaccggcccgagatttgggaaggcgagcctccttgcctgccccccagagatagcctgaaccagagcctgagccaggacctgacaatggcccctggcagcacactgtggctgagctgtggcgtgccacccgactctgtgtccagaggccctctgagctggacccacgtgcaccccaagggacctaagagcctgctgagcctggaactgaaggacgacagacccgccagagatatgtgggtcatggaaaccggcctgctgctgcctagagccacagcccaggatgccggcaagtattactgccaccggggcaacctgaccatgagcttccacctggaaatcaccgccagacccgtgctgtggcactggctgctgagaaccggcggatggaaagtgtccgccgtgaccctggcctacctgatcttctgcctgtgctccctcgtgggcatcctgcatctccagcgggctctggtgctgcggcggaagagaaagagaatgaccgaccccacccggcggttc

SEQ ID NO: 801 - DNA, 246 bp, Artificial Sequence
  Therapeutic Control/Accessory Module
atgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgattctctggacctgtttgggactgagcttaataatttctttggcagttttcgtgctaatgtttttgctaaggaagataaactct

SEQ ID NO: 802 - DNA, 216 bp, Artificial Sequence
  Therapeutic Control/Accessory Module
gcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgc

SEQ ID NO: 803 - DNA, 678 bp, Artificial Sequence
  Therapeutic Control/Accessory Module
gcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 804 - DNA, 342 bp, Artificial Sequence
  Therapeutic Control/Accessory Module
gcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 805 - DNA, 126 bp, Artificial Sequence
  Therapeutic Control/Accessory Module
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 806 - DNA, 336 bp, Artificial Sequence
  Therapeutic Control/Accessory Module
agagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 807 - DNA, 336 bp, Artificial Sequence
  Therapeutic Control/Accessory Module
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 808 - DNA, 324 bp, Artificial Sequence
  Therapeutic Control/Accessory Module
aaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcaggctcctgcacagtgactacatgaacatgactccacgccgccccggacccacccgcaagcattaccagccctatgccccaccacgcgacttcgcagcctatcgctcc

SEQ ID NO: 809 - DNA, 327 bp, Artificial Sequence
  Therapeutic Control/Accessory Module
actagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaa

SEQ ID NO: 810 - DNA, 322 bp, Artificial Sequence
  Therapeutic Control/Accessory Module
ggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcggga

SEQ ID NO: 811 - DNA, 42 bp, Artificial Sequence
  Therapeutic Control/Accessory Module
atggggagtagcaagagcaagcctaaggaccccagccagcgc

SEQ ID NO: 812 - DNA, 1389 bp, Artificial Sequence
  Therapeutic Control/Accessory Module
atgggcagcagcaagagcaagcctaaggaccccagccagagactgaatgctgctggtggacctggcgctggatctgctgctcctgtgtctagcacaagcagcctgcctctggccgctctgaacatgagagtcagaagaaggctgagcctgttcctgaacgtgcggacacaggtggccgctgattggacagctctggccgaggaaatggacttcgagtacctggaaatccggcagctggaaacccaggccgatcctacaggcagactgctggatgcttggcaaggcagaccaggcgcttctgtggggagactgcttgacctgctgacaaagctgggcagagatgacgtgctgctggaactgggacccagcatcgaggaagattgccagaagtacatcctgaagcagcaacaagaagaggccgagaagcctctgcaggttgccgccgtggatagcagcgttccaagaacagctgagctggccggcatcaccacactggatgatcctctgggacacatgcccgagagattcgacgccttcatctgctactgccccagcgacatcgtgggcaagaagcccacaaacaaggcccctcatcctaagcaagagccccaagagatcaacttccccgacgatctgcccggcagcaatactgctgcacccgtgcaagaaaccctgcacggttgtcagcccgtgacacaagaggacggcaaagaaagccggatctccgtccaagagcggcaagttggcggagtgcaggtcgagacaatctctcctggcgacggcagaacattccccaagaggggacagacctgctggcactacaccggaatgctggaagatggcaagaaggtggacagcagccgggacagaaacaagcccttcaagttcatgctgggcaagcaagaagtgattcgcggctgggaagagggcgtcgcacagatgtctgttggacagagagccaagctgacaatcagccccgactacgcctatggcgctacaggacaccctggcatcattcctccacacgccacactggtgttcgacgtggaactgctgaagctggaagtcggaggcgtccaggtggaaaccatcagtccaggcgacggacggacctttcctaagagaggccagacttgttggcattatacagggatgcttgaggacgggaagaaagtggactcctccagagatcggaacaagccgtttaagtttatgctcggaaaacaagaagtcataagaggctgggaagagggtgttgcccaaatgagcgtgggccagcgcgccaaactgaccatctctccagattatgcctacggcgcaaccggccatccaggcattattccacctcatgctaccctggtgtttgatgtcgagctgctcaaactggaa

SEQ ID NO: 813 - DNA, 1620 bp, Artificial Sequence
  Therapeutic Control/Accessory Module
atgtgccatcagcagctcgtgattagctggttcagcctggtgttcctggcctcccccctggtggctatctgggagctgaagaaagacgtgtacgtggtggaactggactggtatcccgacgcccctggcgagatggtggtgctgacctgcgatacccccgaagaggacggcatcacctggaccctggatcagagcagcgaggtgctgggcagcggcaagaccctgaccatccaagtgaaagagttcggcgacgccggccagtacacctgtcacaagggcggagaggtgctgagccacagcttgctgctgctgcacaagaaagaggatggcatttggagcaccgacatcctgaaggaccagaaagagcccaagaacaagaccttcctgagatgcgaggccaagaactacagcggcagattcacctgttggtggctgaccaccatcagcaccgacctgaccttcagcgtgaagtccagcagaggcagcagcgaccctcagggcgtgacatgtggcgctgctacactgagcgccgagagagtgcggggcgacaacaaagaatacgagtacagcgtggaatgccaggaagatagcgcctgccctgccgccgaggaaagcctgcctatcgaagtgatggtggacgccgtgcacaagctgaagtacgagaactacaccagcagctttttcatccgggacatcatcaagcccgacccccccaagaacctccagctgaagcccctgaagaacagcagacaggtggaagtgtcctgggagtaccccgacacctggtccaccccccacagctacttcagcctgacattctgtgtgcaagtgcagggcaagtccaagcgcgagaaaaaggaccgggtgttcaccgacaagaccagcgccaccgtgatctgccggaagaacgccagcatcagcgtgcgcgcccaggatcggtactacagcagctcttggagcgagtgggccagcgtgccatgttctggcggcggaggatctgggggaggcggaagcggagggggaggatctaggaatctgcccgtggctacccccgaccccggcatgtttccttgtctgcaccacagccagaacctgctgcgggccgtgtccaacatgctccagaaggccagacagaccctggagttctacccctgcaccagcgaggaaatcgaccacgaggacatcaccaaggataagaccagcaccgtggaagcctgtctgcccctggaactgaccaagaacgagagctgcctgaacagccgggaaaccagcttcatcaccaacggctcttgcctggcttccagaaagacctccttcatgatggccctgtgcctgagcagcatctacgaggacctgaagatgtaccaggtggagttcaagaccatgaacgccaaactgctgatggaccccaagaggcagattttcctggaccagaatatgctggccgtgatcgacgagctgatgcaggccctgaacttcaacagcgagacagtgccccagaagtcctccctggaagaacccgacttctacaagaccaagatcaagctgtgcatcctgctgcacgccttcagaatccgggccgtgaccatcgacagagtgatgagctacctgaacgcctcc

SEQ ID NO: 814 - DNA, 762 bp, Artificial Sequence
  Therapeutic Control/Accessory Module
atggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaa

SEQ ID NO: 815 - DNA, 783 bp, Artificial Sequence
  Therapeutic Control/Accessory Module
atgatcgagacatacaaccagaccagccccagaagcgccgccaccggactgcccatcagcatgaagattttcatgtacctgctgaccgtgttcctgattacccagatgatcggcagcgccctgttcgccgtgtacctgcacagacggctggacaagatcgaggacgagcggaacctgcacgaggacttcgtgtttatgaagaccatccagcggtgcaacaccggcgagagaagcctgagcctgctgaactgcgaggaaatcaagagccagttcgagggcttcgtgaaggacatcatgctgaacaaagaggaaactaagaaagaaaacagcttcgagatgcagaagggcgaccagaacccccagattgccgcccacgtgatctctgaggccagcagcaagaccacctccgtgctccagtgggccgagaagggctactacaccatgagcaacaacctcgtgaccctggaaaacggcaagcaactgaccgtgaagcggcagggcctgtactacatctacgcccaagtgaccttctgctccaacagagaggccagctcccaggccccctttatcgccagcctgtgcctgaagtcccccggcagattcgagagaatcctgctgagagccgccaacacccacagcagcgccaagccttgtggacagcagagcatccacctgggcggcgtgttcgagcttcagcctggcgcttccgtgttcgtgaacgtgaccgaccctagccaggtgtcccacggcaccggctttaccagcttcggactgctgaagctg

SEQ ID NO: 816 - DNA, 564 bp, Kaposi's sarcoma-associated herpesvirus
atggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacacca

SEQ ID NO: 817 - DNA, 723 bp, Artificial Sequence
  Therapeutic Control/Accessory Module
atgtccgactccaaggaggtccctagccttccatttttgcgacacttgctcgaagagttggacagccatgaggacagcttgctgctgtttctgtgtcacgacgcggccccgggctgcacgacggtcacgcaagctttgtgctcgcttagccaacagcgcaagctgaccctcgcggctctggtcgagatgctctacgtgctgcagcgtatggatcttctcaagagccgcttcgggctcagcaaggagggggccgagcaattgctgggcacaagctttctcacgcgctaccgcaagctcatggtttgcgtgggtgaggagctcgactcgagcgagctacgcgctctacgcttgttcgcgtgcaacctgaatccgagcctgagcacggcgctttctgagagcagccgctttgtcgagcttgtactcgcgcttgaaaacgtaggactcgtctcgccatcgagtgtttccgtgcttgcggacatgttgcgcactcttcggcgcctcgatttgtgccagcagcttgttgagtacgaacaacaagagcaagccaggtaccgttactgttacgcggcctcgccctcattgccagttcgtacgttacgtcgggggcacggcgcgagtgaacacgagcagctgtgcatgcccgtgcaagaatcctctgacagccccgagctgctgcgcacgcccgtacaagaatcctccagcgacagccccgagcaaacgact

SEQ ID NO: 818 - DNA, 1440 bp, Homo sapiens
atgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacaca

SEQ ID NO: 819 - DNA, 588 bp, Artificial Sequence
  Therapeutic Control/Accessory Module
atgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggat

SEQ ID NO: 820 - DNA, 903 bp, Artificial Sequence
  Therapeutic Control/Accessory Module
atgactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacacca

SEQ ID NO: 821 - DNA, 1224 bp, Artificial Sequence
  Therapeutic Control/Accessory Module
atgggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacacca

SEQ ID NO: 822 - DNA, 1059 bp, Human T-cell lymphotropic virus type 1
atggcccatttcccagggtttggacagagtcttcttttcggatacccagtctacgtgtttggagactgtgtacaaggcgactggtgccccatctctgggggactatgttcggcccgcctacatcgtcacgccctactggccacctgtccagagcatcagatcacctgggaccccatcgacggacgcgttatcggctcagctctacagttccttatccctcgactcccctccttccccacccagagaacctctaagaccctcaaggtccttaccccgccaatcactcatacaacccccaacattccaccctccttcctccaggccatgcgcaaatactcccccttccgaaatggatacatggaacccacccttgggcagcacctcccaaccctgtcttttccagaccccggactccggccccaaaacctgtacaccctctggggaggctccgttgtctgcatgtacctctaccagctttccccccccatcacctggcccctcctgccccacgtgattttttgccaccccggccagctcggggccttcctcaccaatgttccctacaagcgaatagaagaactcctctataaaatttccctcaccacaggggccctaataattctacccgaagactgtttgcccaccacccttttccagcctgctagggcacccgtcacgctaacagcctggcaaaacggcctccttccgttccactcaaccctcaccactccaggccttatttggacatttaccgatggcacgcctatgatttccgggccctgccctaaagatggccagccatctttagtactacagtcctcctcctttatatttcacaaatttcaaaccaaggcctaccacccctcatttctactctcacacggcctcatacagtactcttcctttcatagtttacatctcctgtttgaagaatacaccaacatccccatttctctactttttaacgaaaaagaggcagatgacaatgaccatgagccccaaatatcccccgggggcttagagcctcccagtgaaaaacatttccgagaaacagaagtc

SEQ ID NO: 823 - DNA, 1068 bp, Artificial Sequence
  Therapeutic Control/Accessory Module
atggcgcactttccgggctttggacagtcactcctgtacggctatcccgtctatgtattcggtgattgtgtgcaagccgattggtgtccagtgtccggtggtctgtgcagtacacggcttcaccggcacgccctgctggcaacttgccccgaacaccagcttacatgggacccaatcgacggtcgcgtagtgtcttctcccctccagtatctgattcctagattgccttcctttccaacacagaggaccagccggaccctgaaggttctgaccccaccgactacaccagtgtcccccaaagtgcctcccgccttcttccaaagtatgagaaaacatactccctataggaatggctgcttggagccaaccctcggtgaccaactcccctcactcgccttccccgaacctggcctgcgcccacagaacatctatactacttggggcaagactgtggtatgcctttacctgtaccagctgagtcccccgatgacatggcccctcatcccccacgtcattttctgtcacccacggcagctgggagcgttccttaccaaagttccgctcaaacgcctggaggaactgctgtataagatgtttctgcacactggtgccgtgatcgtgctgcccgaggacgatctgcccaccacaatgttccagccggtgcgggctccttgcatccagactgcttggtgcacaggccttctgccttaccactccatactcacaacccctggtctgatctggaccttcaatgacggaagccctatgatttcaggaccttgtcccaaggctggacagccatctctggttgtgcagtcatctctgctcatcttcgagaaattccaaaccaaggcctttcatccatcctacctcctctcccatcagctgatacagtacagctccttccacaacttgcacctgctctttgatgaatatacgaatattccagtcagcatactcttcaacaagggcgaggccgatgataatggcgaccagccgcctgagcctgccgcacagggtgaaagctccacacagaaggtgcggccctcccatactaacaatccaaag

SEQ ID NO: 824 - DNA, 1068 bp, Artificial Sequence
  Therapeutic Control/Accessory Module
atggcgcactttccgggctttggacagtcactcctgtacggctatcccgtctatgtattcggtgattgtgtgcaagccgattggtgtccagtgtccggtggtctgtgcagtacacggcttcaccggcacgccctgctggcaacttgccccgaacaccagcttacatgggacccaatcgacggtcgcgtagtgtcttctcccctccagtatctgattcctagattgccttcctttccaacacagaggaccagccggaccctgaaggttctgaccccaccgactacaccagtgtcccccaaagtgcctcccgccttcttccaaagtatgagaaaacatactccctataggaatggctgcttggagccaaccctcggtgaccaactcccctcactcgccttccccgaacctggcctgcgcccacagaacatctatactacttggggcaagactgtggtatgcctttacctgtaccagctgagtcccccgatgacatggcccctcatcccccacgtcattttctgtcacccacggcagctgggagcgttccttaccaaagttccgctcaaacgcctggaggaactgctgtataagatgtttctgcacactggtgccgtgatcgtgctgcccgaggacgatctgcccaccacaatgttccagccggtgcgggctccttgcatccagactgcttggtgcacaggccttctgccttaccactccatactcacaacccctggtctgatctggaccttcaatgacggaagccctatgatttcaggaccttgtcccaaggctggacagccatctctggttgtgcagtcatctctgctcatcttcgagaaattccaaaccaaggcctttcatccatcctacctcctctcccatcagctgatacagtacagctccttccacaacttgcacctgctctttgatgaatatacgaatattccagtcagcagaagcttcaacaagggcgaggccgatgataatggcgaccagccgcctgagcctgccgcacagggtgaaagctccacacagaaggtgcggccctcccatactaacaatccaaag

SEQ ID NO: 825 - DNA, 1200 bp, Artificial Sequence
  Therapeutic Control/Accessory Module
atgctggaaggcgtgcaggtggaaaccatcagccctggcgacggcagaaccttccctaagaggggccagacctgcgtggtgcactacaccggaatgctggaagatggcaagaaggtggacagcagccgggaccggaacaagcccttcaagttcatgctgggcaagcaggaagtgatccggggctgggaagagggcgtggcccagatgtctgtgggccagagagccaagctgaccatctcccccgattacgcctacggcgctacaggccaccctggcatcattcctccacacgccacactggtgttcgacgtggaactgctgaagctggaaagcggcggaggcagcggagtggatggcttcggagatgtgggagccctggaaagcctgagaggcaacgccgacctggcctacatcctgagcatggaaccttgcggccactgcctgattatcaacaacgtgaacttctgccgcgagagcggcctgagaaccagaaccggcagcaacatcgactgcgagaagctgcggcggagattcagcagcctgcacttcatggtggaagtgaagggcgacctgaccgccaagaaaatggtgctggccctgctggaactggcccagcaggatcatggcgctctggactgctgtgtggtcgtgatcctgagccacggctgccaggcttcccatcttcagttccctggcgctgtgtacggcaccgatggctgtcctgtgtccgtggaaaagatcgtgaacatcttcaacggcaccagctgccccagcctgggcggaaagcccaagctgttctttattcaagcctgtggcggcgagcagaaggaccacggctttgaggtggcctccaccagccctgaggatgagagccctggcagcaaccctgagcctgacgccaccccattccaggaaggactgcggaccttcgaccagctggacgccatctctagcctgcccacccccagcgacatcttcgtgtcctacagcaccttccccggctttgtgtcctggcgggaccctaagagcggctcttggtacgtggaaaccctggacgacatctttgagcagtgggctcacagcgaggacctccagagcctgctgctgagagtggctaacgccgtgtccgtgaagggcatctacaagcagatgcctggctgcttcaacttcctgcggaagaagctgtttttcaagaccagc

SEQ ID NO: 826 - DNA, 810 bp, Artificial Sequence
  Therapeutic Control/Accessory Module
atggattggatatggaggatactttttctcgtgggggcagcaaccggggctcattccgaggttcagttggtcgaatcaggcgggggcctcgtccaacccggcggaagcctgcggctgtcttgcgcagcaagtggtagtgtgttcaagatcaacgttatggcctggtatcgccaggctccgggaaaagggagagagctggttgcggggatcattagcggtggctccaccagctacgctgacagtgtgaagggaaggttcactatatcacgcgacaacgcaaagaatacattgtacctccagatgaatagcttgcggcccgaagacacggcagtctactattgtgcctttatcacaacagagagcgactatgacctgggccgccggtattgggggcagggaacccttgtgaccgtttcatccggcggaggcggaagtggaggcggaggatctggcggcggaggctctgaggtgcagctcgtggaatcaggcggaggtcttgtacagccaggaaattctcttcggctgtcttgcgccgcgagcgggttcaccttcagcagcttcggaatgagctgggtaagacaggcaccggggaaaggcctggagtgggtgagctcaatcagtgggagcgggtcagataccctgtacgcggattccgtgaagggcagattcacaatctctcgggacaatgctaagacaacactttaccttcagatgaactctctgcgacccgaggataccgctgtctactactgtacaataggaggttctctgtccagaagttctcaagggacactggtgaccgtctccagc

SEQ ID NO: 827 - DNA, 738 bp, Artificial Sequence
  Therapeutic Control/Accessory Module
atggccctgcctgtgacagctctgctgctgcctctggcactgctgctgcacgccgccagacctgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcgaggacttcgccgtgtactactgccagcagagcaccttcggccagggcaccaaggtggaaatcaagggcggaggcggatctggcggcggaggatctgggggaggcggctctcaggtgtacctggtggaaagcggagggggcgtggtgcagcctggaagaagcctgagactgagctgtgccgccagcggcttcaccttcagcaactacggaatgcactgggtgcgccaggcccctggcaaaggactggaatgggtggccctgatttggtacgacggcagcaacaagtattacgccgacagcgtgaagggccggttcaccatcagccgggacaacagcaagaacaccctgtacctccagatgaccagcctgcgggtggaagataccgccgtgtattattgcgccagcaacgtggaccactggggccagggaacactcgtgaccgtgtctagc

SEQ ID NO: 828 - DNA, 759 bp, Artificial Sequence
  Therapeutic Control/Accessory Module
atggccctgcctgtgacagctctgctgctgcctctggcactgctgctgcacgccgccagacctgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacctttggacagggcaccaaggtggaaatcaagggcggaggcggatctggcggcggaggatctgggggaggcggctctcaggtgcagctggtggaaagtgggggaggatggcagcctggcagaagcctgagactggactgcaaggccagcggcatcaccttcagcaacagcggaatgcactgggtgcgccaggcccctggaaagggactggaatgggtggccgtgatctatgacggcagcaagcggtactacgccgacagcgtgaagggccggttcatcagccgggacaacagcaagaataccctgttcctccagatgaacagcctgcgggccgaggacacagccgtgtattattgcgccaccaacgacgactactggggccagggaacactcgtgaccgtgtcctct

SEQ ID NO: 829 - DNA, 789 bp, Artificial Sequence
  Therapeutic Control/Accessory Module
atggccctgcctgtgacagctctgctgctgcctctggcactgctgctgcacgccgccagacctgagatcgtgctgacacagagccctggcacactgtcactgtctccaggcgaaagagccacactgagctgtagagcctctcagagcgtgggcagctcttacctggcttggtatcagcagaagcccggacaggctcccagactgctgatctacggcgctttcagcagagccacaggcatccccgatagattttctggcagcggctccggcaccgacttcaccctgacaatcagcagactggaacccgaggacttcgccgtgtactactgtcagcagtacggcagcagcccttggacctttggacagggcaccaaggtggaaatcaagagaggcggaggcggaagtggaggcggaggatctggcggcggaggctctcaagtgcagctggttgaatcaggtggcggcgttgtgcagcctggcagaagtctgagactgtcttgtgccgccagcggcttcaccttcagcagctacacaatgcactgggtccgacaggcccctggcaaaggactggaatgggtcacctttatcagctacgacggcaacaacaagtattacgccgacagcgtgaagggcagattcaccatctccagagacaacagcaagaacaccctgtacctccagatgaacagcctgagagccgaggacaccgccatctactactgcgccagaacaggatggctgggacccttcgattattggggccagggcacactcgtgaccgtgtcatct

SEQ ID NO: 830 - DNA, 1128 bp, Artificial Sequence
  Therapeutic Control/Accessory Module
atggccctgcctgtgacagctctgctgctgcctctggcactgctgctgcacgccgccagacctgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcgaggacttcgccgtgtactactgccagcagagcaccttcggccagggcaccaaggtggaaatcaagggcggaggcggatctggcggcggaggatctgggggaggcggctctcaggtgtacctggtggaaagcggagggggcgtggtgcagcctggaagaagcctgagactgagctgtgccgccagcggcttcaccttcagcaactacggaatgcactgggtgcgccaggcccctggcaaaggactggaatgggtggccctgatttggtacgacggcagcaacaagtattacgccgacagcgtgaagggccggttcaccatcagccgggacaacagcaagaacaccctgtacctccagatgaccagcctgcgggtggaagataccgccgtgtattattgcgccagcaacgtggaccactggggccagggaacactcgtgaccgtgtctagcggcggaggcggaagtggaggcggaggatctggcggcggaggctctgaggtgcagctcgtggaatcaggcggaggtcttgtacagccaggaaattctcttcggctgtcttgcgccgcgagcgggttcaccttcagcagcttcggaatgagctgggtaagacaggcaccggggaaaggcctggagtgggtgagctcaatcagtgggagcgggtcagataccctgtacgcggattccgtgaagggcagattcacaatctctcgggacaatgctaagacaacactttaccttcagatgaactctctgcgacccgaggataccgctgtctactactgtacaataggaggttctctgtccagaagttctcaagggacactggtgaccgtctccagc

SEQ ID NO: 831 - DNA, 1149 bp, Artificial Sequence
  Therapeutic Control/Accessory Module
atggccctgcctgtgacagctctgctgctgcctctggcactgctgctgcacgccgccagacctgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacctttggacagggcaccaaggtggaaatcaagggcggaggcggatctggcggcggaggatctgggggaggcggctctcaggtgcagctggtggaaagtgggggaggatggcagcctggcagaagcctgagactggactgcaaggccagcggcatcaccttcagcaacagcggaatgcactgggtgcgccaggcccctggaaagggactggaatgggtggccgtgatctatgacggcagcaagcggtactacgccgacagcgtgaagggccggttcatcagccgggacaacagcaagaataccctgttcctccagatgaacagcctgcgggccgaggacacagccgtgtattattgcgccaccaacgacgactactggggccagggaacactcgtgaccgtgtcctctggcggaggcggaagtggaggcggaggatctggcggcggaggctctgaggtgcagctcgtggaatcaggcggaggtcttgtacagccaggaaattctcttcggctgtcttgcgccgcgagcgggttcaccttcagcagcttcggaatgagctgggtaagacaggcaccggggaaaggcctggagtgggtgagctcaatcagtgggagcgggtcagataccctgtacgcggattccgtgaagggcagattcacaatctctcgggacaatgctaagacaacactttaccttcagatgaactctctgcgacccgaggataccgctgtctactactgtacaataggaggttctctgtccagaagttctcaagggacactggtgaccgtctccagc

SEQ ID NO: 832 - DNA, 1179 bp, Artificial Sequence
  Therapeutic Control/Accessory Module
atggccctgcctgtgacagctctgctgctgcctctggcactgctgctgcacgccgccagacctgagatcgtgctgacacagagccctggcacactgtcactgtctccaggcgaaagagccacactgagctgtagagcctctcagagcgtgggcagctcttacctggcttggtatcagcagaagcccggacaggctcccagactgctgatctacggcgctttcagcagagccacaggcatccccgatagattttctggcagcggctccggcaccgacttcaccctgacaatcagcagactggaacccgaggacttcgccgtgtactactgtcagcagtacggcagcagcccttggacctttggacagggcaccaaggtggaaatcaagagaggcggaggcggaagtggaggcggaggatctggcggcggaggctctcaagtgcagctggttgaatcaggtggcggcgttgtgcagcctggcagaagtctgagactgtcttgtgccgccagcggcttcaccttcagcagctacacaatgcactgggtccgacaggcccctggcaaaggactggaatgggtcacctttatcagctacgacggcaacaacaagtattacgccgacagcgtgaagggcagattcaccatctccagagacaacagcaagaacaccctgtacctccagatgaacagcctgagagccgaggacaccgccatctactactgcgccagaacaggatggctgggacccttcgattattggggccagggcacactcgtgaccgtgtcatctggcggaggcggaagtggaggcggaggatctggcggcggaggctctgaggtgcagctcgtggaatcaggcggaggtcttgtacagccaggaaattctcttcggctgtcttgcgccgcgagcgggttcaccttcagcagcttcggaatgagctgggtaagacaggcaccggggaaaggcctggagtgggtgagctcaatcagtgggagcgggtcagataccctgtacgcggattccgtgaagggcagattcacaatctctcgggacaatgctaagacaacactttaccttcagatgaactctctgcgacccgaggataccgctgtctactactgtacaataggaggttctctgtccagaagttctcaagggacactggtgaccgtctccagc

SEQ ID NO: 833 - DNA, 777 bp, Artificial Sequence
  Therapeutic Control/Accessory Module
atggactggatttggcgcatccttttccttgtcggcgctgctaccggcgcgcattctgagattgtactgactcagtctcccgctactctgtccctttcccccggcgaacgcgcgaccctctcatgctcagccagcatctctgtgtcttacatgtattggtatcagcaaaagcctgggcaagcgccaagactgctgatatacgacatgtccaacctggcaagcggcatcccggcgagattctccggatctggctcagggaccgattttacgctcactatcagttccttggagcctgaggatttcgcggtgtattactgtatgcagtggagcggttatccttacacatttggaggcggaactaaagtggagataaagggcggtggcggttcaggtggagggggaagcggtggtggtggctcagaggtgcaactcgtggagtccggtggcggtctggtgcagccaggggggtccttgcgcctgagctgcgccgcttctgggtttacgttttccccattcgctatgtcctgggtccggcaggcgcccggtaaaggtctggaatgggtggcaaagatttccccaggggggtcttggacttattactccgacaccgtgacaggtcgatttaccatcagcagggataacgccaaaaacagcctctacctccagatgaactccttgcgagccgaagataccgccgtctattactgtgccaggcagctgtggggatactacgcgctggacatttgggggcagggaacaactgtgactgtatcctca

SEQ ID NO: 834 - DNA, 141 bp, Artificial Sequence
  Therapeutic Control/Accessory Module
atggactggatttggcgcatccttttccttgtcggcgctgctaccggcgcgcattctggccacagaccactggacaagaagcgggaagaggcgccctccctgcgcccagctcctccacccatcagtgggggtggctacaga

SEQ ID NO: 835 - DNA, 492 bp, Artificial Sequence
  Therapeutic Control/Accessory Module
atgaagtggaaggccctgttcaccgccgccattctccaggcccaactgcctatcacagaggcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaaga

SEQ ID NO: 836 - DNA, 618 bp, Artificial Sequence
  Therapeutic Control/Accessory Module
atgaagtggaaggccctgttcaccgccgccattctccaggcccaactgcctatcacagaggcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaaga

SEQ ID NO: 837 - DNA, 630 bp, Artificial Sequence
  Therapeutic Control/Accessory Module
atgaagtggaaggccctgttcaccgccgccattctccaggcccaactgcctatcacagaggcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaggcggcggatccaagagaggccggaagaagctgctgtacatcttcaagcagcctttcatgcggcccgtgcagaccacccaggaagaggacggctgctcctgccggttccccgaggaagaagaaggcggctgcgagctg

SEQ ID NO: 838 - DNA, 501 bp, Artificial Sequence
  Therapeutic Control/Accessory Module
aaagagagcagcggcggacccgacagccctgatacagagcctggaagctctgccggacctacccagaggcccagcgacaacagccacaatgaacacgcccctgccagccagggactgaaggccgagcacctgtacatcctgatcggcgtgtccgtggtgttcctgttctgcctgctgctgctggtgctgttctgtctgcaccggcagaaccagatcaagcagggacctcccagaagcaaggacgaggaacagaagcctcagcagaggcccgacctggccgtggacgtgctggaaagaacagccgacaaggccaccgtgaacggcctgcccgagaaggacagagagacagacacaagcgccctggccgctggcagctctcaggaagtgacatacgcccagctggaccactgggctctgacccagagaacagccagagccgtgtccccccagagcaccaaacctatggccgagagcatcacctacgccgccgtggctagacac

SEQ ID NO: 839 - DNA, 558 bp, Artificial Sequence
  Therapeutic Control/Accessory Module
atggccctgcctgtgacagctctgctgctgcctctggcactgctgctgcacgccgccagacctgcactgcctagctgcaaagaggacgagtaccctgtcggcagcgagtgctgtcctaagtgtagccctggctacagagtgaaagaagcctgcggagagctgaccggcaccgtgtgtgaaccttgtcctcctggcacctatatcgcccacctgaacggcctgagcaagtgcctgcagtgccagatgtgcgatcctgctatgggcctgagagccagcagaaactgcagcagaaccgagaatgccgtgtgcggctgttctcccggccacttctgtattgtgcaggacggcgatcactgcgccgcctgtagagcctatgccacatctagccctggacagcgggttcagaaaggcggcacagagtctcaggataccctgtgccagaattgccctccaggcacattcagccccaacggcacactggaagagtgccagcaccagaccaagtgtagctggctggtcacaaaagccggcgctggcacaagcagctctcattgggtg

SEQ ID NO: 840 - DNA, 948 bp, Artificial Sequence
  Therapeutic Control/Accessory Module
atggccctgcctgtgacagctctgctgctgcctctggcactgctgctgcacgccgccagacctgcactgcctagctgcaaagaggacgagtaccctgtcggcagcgagtgctgtcctaagtgtagccctggctacagagtgaaagaagcctgcggagagctgaccggcaccgtgtgtgaaccttgtcctcctggcacctatatcgcccacctgaacggcctgagcaagtgcctgcagtgccagatgtgcgatcctgctatgggcctgagagccagcagaaactgcagcagaaccgagaatgccgtgtgcggctgttctcccggccacttctgtattgtgcaggacggcgatcactgcgccgcctgtagagcctatgccacatctagccctggacagcgggttcagaaaggcggcacagagtctcaggataccctgtgccagaattgccctccaggcacattcagccccaacggcacactggaagagtgccagcaccagaccaagtgtagctggctggtcacaaaagccggcgctggcacaagcagctctcattgggtgggcggaggcggaagtggaggcggaggatctggcggcggaggctctgaggtgcagctcgtggaatcaggcggaggtcttgtacagccaggaaattctcttcggctgtcttgcgccgcgagcgggttcaccttcagcagcttcggaatgagctgggtaagacaggcaccggggaaaggcctggagtgggtgagctcaatcagtgggagcgggtcagataccctgtacgcggattccgtgaagggcagattcacaatctctcgggacaatgctaagacaacactttaccttcagatgaactctctgcgacccgaggataccgctgtctactactgtacaataggaggttctctgtccagaagttctcaagggacactggtgaccgtctccagc

SEQ ID NO: 841 - DNA, 3399 bp, Homo sapiens
atgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgttgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcggggctgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactga

SEQ ID NO: 842 - DNA, 1632 bp, Homo sapiens
atgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaagaagctctgtagatgtgctatacacttttgcaaactgctcaggactggacttgatctttggcctaaatgcgttattaagaacagcagatttgcagtggaacagttctaatgctcagttgctcctggactactgctcttccaaggggtataacatttcttgggaactaggcaatgaacctaacagtttccttaagaaggctgatattttcatcaatgggtcgcagttaggagaagattttattcaattgcataaacttctaagaaagtccaccttcaaaaatgcaaaactctatggtcctgatgttggtcagcctcgaagaaagacggctaagatgctgaagagcttcctgaaggctggtggagaagtgattgattcagttacatggcatcactactatttgaatggacggactgctaccaaggaagattttctaaaccctgatgtattggacatttttatttcatctgtgcaaaaagttttccaggtggttgagagcaccaggcctggcaagaaggtctggttaggagaaacaagctctgcatatggaggcggagcgcccttgctatccgacacctttgcagctggctttatgtggctggataaattgggcctgtcagcccgaatgggaatagaagtggtgatgaggcaagtattctttggagcaggaaactaccatttagtggatgaaaacttcgatcctttacctgattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctga

SEQ ID NO: 843-859 - skipped (17 entries)

SEQ ID NO: 860 - DNA, 2000 bp, Artificial Sequence
  Synthetic polynucleotide. This sequence may encompass 100-5,000 nucleotides, wherein some positions may be absent.
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 861 - DNA, 1358 bp, Artificial Sequence
  Synthetic polynucleotide. This sequence may encompass 100-5,000 nucleotides wherein some positions may be absent.
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 862 - DNA, 5016 bp, Artificial Sequence
  Synthetic polynucleotide. This sequence may encompass 100-5,000 nucleotides wherein some positions may be absent.
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 863 - DNA, 2400 bp, Artificial Sequence
  Synthetic polynucleotide. This sequence may encompass 100-5,000 nucleotides wherein some positions may be absent.
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 864 - DNA, 10 bp, Artificial Sequence
  Synthetic polynucleotide encoding a DNA Barcode
aaacaaacac

SEQ ID NO: 865 - DNA, 10 bp, Artificial Sequence
  Synthetic polynucleotide encoding a DNA barcode
aaacaagggt

SEQ ID NO: 866 - DNA, 10 bp, Artificial Sequence
  Synthetic polynucleotide encoding a DNA barcode
aaacatctct

SEQ ID NO: 867 - DNA, 10 bp, Artificial Sequence
  Synthetic polynucleotide encoding a DNA barcode
aaaccctgac

SEQ ID NO: 868 - DNA, 10 bp, Artificial Sequence
  Synthetic polynucleotide encoding a DNA barcode
aaacgggaac

SEQ ID NO: 869 - DNA, 10 bp, Artificial Sequence
  Synthetic polynucleotide encoding a DNA barcode
aaagacagta

SEQ ID NO: 870 - DNA, 7488 bp, Artificial Sequence
  Synthetic Polynucleotide. pLenti-EF1a Vector.
  misc_feature (3291)..(3294): n is a, c, g, or t
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcnnnngtcgactccggatgatcagggccctgtacagatatcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 871 - DNA, 6887 bp, Artificial Sequence
  Synthetic Polynucleotide. pLenti-EF1a-DWPRE Vector.
  misc_feature (3291)..(3294): n is a, c, g, or t
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcnnnngtcgacggcgaatccggactatagtgtcacctaaatgctagacgtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 872 - DNA, 5150 bp, Artificial Sequence
  Synthetic Polynucleotide. MSCV-Bgl2-AvrII-Bam-EcoR1-Xho-BstB1-Mlu-Sal-ClaI.I03 Vector.
tgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcccagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccggaattagatctcctaggatccaagaattcggctcgagttcgaagggacgcgtaatgtcgacatcgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatagttcattatggacagcgcagaagagctggggagaattaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggcgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgattagtccaatttgttaaagacaggatatcagtggtccaggctctagttttgactcaacaatatcaccagctgaagcctatagagtacgagccatagataaaataaaagattttatttagtctccagaaaaaggggggaa

SEQ ID NO: 873 - DNA, 7764 bp, Artificial Sequence
  Synthetic Polynucleotide. MSCV-FMC63-vL-V5-[TCRb-KACIAH]-F-P2A-2-Spe-FMC63-vH-MYC-[TCRa-CSD VP]-F-F2A-Pac.N01 Vector.
tgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcccagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccggaattagatctcctagcaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggagcagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgagtcgacatcgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatagttcattatggacagcgcagaagagctggggagaattaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggcgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgattagtccaatttgttaaagacaggatatcagtggtccaggctctagttttgactcaacaatatcaccagctgaagcctatagagtacgagccatagataaaataaaagattttatttagtctccagaaaaaggggggaa

SEQ ID NO: 874 - DNA, 5857 bp, Artificial Sequence
  Synthetic Polynucleotide. pSBbi-Pur Sleeping Beauty Vector.
aattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggatccctatacagttgaagtcggaagtttacatacaccttagccaaatacatttaaactcactttttcacaattcctgacatttaatcctagtaaaaattccctgtcttaggtcagttaggatcaccactttattttaagaatgtgaaatatcagaataatagtagagagaatgattcatttcagcttttatttctttcatcacattcccagtgggtcagaagtttacatacactcgactcctctgcagaatgcggcgatgtttcggtaaggggtcccgagtagctagttcatggcagccagcatatggcatatgttgccaaactctaaaccaaatactcattctgatgttttaaatgatttgccctcccatatgtccttccgagtgagagacacaaaaaattccaacacactattgcaatgaaaataaatttcctttattagccagaagtcagatgctcaaggggcttcatgatgtccccataatttttggcagagggaaaaagatctcagtggtatttgtgagccagggcattggccacaccagccaccaccttctgataggcagcctgcacctgaggagtgaattcacgacaggccttcgaatcaggcaccgggcttgcgggtcatgcaccaggtgcgcggtccttcgggcacctcgacgtcggcggtgacggtgaagccgagccgctcgtagaaggggaggttgcggggcgcggaggtctccaggaaggcgggcaccccggcgcgctcggccgcctccactccggggagcacgacggcgctgcccagacccttgccctggtggtcgggcgagacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcctcaggtgcagaggtttctacagggaaagagagaaaggctacagttagtttgctgtgatgatgctaagtgccgaggtcagatgtctatggattgtacacggaatcccaacgcaggaaccaaaaaacactcacccaaaaaaatggcgctaaggccgagagaaaggcgaagttccgtctacggctatataccttgaaacaggggcggcagaagtgacgcaacgcggttgcgcggacggcttcctgtgttttcattggtcgaagcgttctgcgcgtgcgcagagattccccagggaaggcgggccctcttccgaatgtccaatccggacattcttccggttggacctccgcggtcagcgctgtgcccggcgagagatcacgtggggcgcggaggcggtgctgctggggcacggccgtccagcctcggcggccatatttttgaggggctgttcatctcgttcacacgctctgtccgccatgtttgtgagtggaagcgccattaccccttcaagcgactgaaggctgcagggcctctggtggcccgcatggggagaccagacccgccaggcccgcctttccgcactcagtccgggcttactttattttgtgagacagggtctcgcctagaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcttggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccatactgagtgggtggagactgaagttaggccagcttggcacttgatgtaattctccttggaatttgccctttttgagtttggatcttggttcattctcaagcctcagacagtggttcaaagtttttttcttccatttaaggtgtcgtgaaaactaccccaagctggcctctgaggccaccatggctcgagtttcgaactcaattatactgaattgtttcatcatagggttcaacattgtgataaatcaggacttcaatgtctagtgttcagtaaataccttgtagggctctccaaaaaggggaatcttttcaggaaatgcctctttctcttggtgggcttcctggttgcgtctttccttctctctaattcgaaggcctgtcaggccaagcttggggatcaattctctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctgggcctactagatagcggaccccttaccgaaacatcgccgcattctgcagaggagtcgaacttagtgtatgtaaacttctgacccactggaattgtgatacagtgaattataagtgaaataatctgtctgtaaacaattgttggaaaaatgacttgtgtcatgcacaaagtagatgtcctaactgacttgccaaaactattgtttgttaacaagaaatttgtggagtagttgaaaaacgagttttaatgactccaacttaagtgtatgtaaacttccgacttcaactgtatagggatcc

SEQ ID NO: 875 - DNA, 7735 bp, Artificial Sequence
  Synthetic Polynucleotide. SIR encoding Sleeping Beauty Vector pSBbi-pur-EF1a-FMC63-vL-V5-[TCRb-KACIAH]-F-P2A-FMC63-vH-MYC-[TCRa -CSDVP]-F-F2A-Xba.B01.
aattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggatccctatacagttgaagtcggaagtttacatacaccttagccaaatacatttaaactcactttttcacaattcctgacatttaatcctagtaaaaattccctgtcttaggtcagttaggatcaccactttattttaagaatgtgaaatatcagaataatagtagagagaatgattcatttcagcttttatttctttcatcacattcccagtgggtcagaagtttacatacactcgactcctctgcagaatgcggcgatgtttcggtaaggggtcccgagtagctagttcatggcagccagcatatggcatatgttgccaaactctaaaccaaatactcattctgatgttttaaatgatttgccctcccatatgtccttccgagtgagagacacaaaaaattccaacacactattgcaatgaaaataaatttcctttattagccagaagtcagatgctcaaggggcttcatgatgtccccataatttttggcagagggaaaaagatctcagtggtatttgtgagccagggcattggccacaccagccaccaccttctgataggcagcctgcacctgaggagtgaattcacgacaggccttcgaatcaggcaccgggcttgcgggtcatgcaccaggtgcgcggtccttcgggcacctcgacgtcggcggtgacggtgaagccgagccgctcgtagaaggggaggttgcggggcgcggaggtctccaggaaggcgggcaccccggcgcgctcggccgcctccactccggggagcacgacggcgctgcccagacccttgccctggtggtcgggcgagacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcctcaggtgcagaggtttctacagggaaagagagaaaggctacagttagtttgctgtgatgatgctaagtgccgaggtcagatgtctatggattgtacacggaatcccaacgcaggaaccaaaaaacactcacccaaaaaaatggcgctaaggccgagagaaaggcgaagttccgtctacggctatataccttgaaacaggggcggcagaagtgacgcaacgcggttgcgcggacggcttcctgtgttttcattggtcgaagcgttctgcgcgtgcgcagagattccccagggaaggcgggccctcttccgaatgtccaatccggacattcttccggttggacctccgcggtcagcgctgtgcccggcgagagatcacgtggggcgcggaggcggtgctgctggggcacggccgtccagcctcggcggccatatttttgaggggctgttcatctcgttcacacgctctgtccgccatgtttgtgagtggaagcgccattaccccttcaagcgactgaaggctgcagggcctctggtggcccgcatggggagaccagacccgccaggcccgcctttccgcactcagtccgggcttactttattttgtgagacagggtctcgcctagaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctgggcctactagatagcggaccccttaccgaaacatcgccgcattctgcagaggagtcgaacttagtgtatgtaaacttctgacccactggaattgtgatacagtgaattataagtgaaataatctgtctgtaaacaattgttggaaaaatgacttgtgtcatgcacaaagtagatgtcctaactgacttgccaaaactattgtttgttaacaagaaatttgtggagtagttgaaaaacgagttttaatgactccaacttaagtgtatgtaaacttccgacttcaactgtatagggatcc

SEQ ID NO: 876 - DNA, 7780 bp, Artificial Sequence
  Synthetic Polynucleotide
aattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggatccctatacagttgaagtcggaagtttacatacaccttagccaaatacatttaaactcactttttcacaattcctgacatttaatcctagtaaaaattccctgtcttaggtcagttaggatcaccactttattttaagaatgtgaaatatcagaataatagtagagagaatgattcatttcagcttttatttctttcatcacattcccagtgggtcagaagtttacatacactcgactcctctgcagaatgcggcgatgtttcggtaaggggtcccgagtagctagttcatggcagccagcatatggcatatgttgccaaactctaaaccaaatactcattctgatgttttaaatgatttgccctcccatatgtccttccgagtgagagacacaaaaaattccaacacactattgcaatgaaaataaatttcctttattagccagaagtcagatgctcaaggggcttcatgatgtccccataatttttggcagagggaaaaagatctcagtggtatttgtgagccagggcattggccacaccagccaccaccttctgataggcagcctgcacctgaggagtgaattcacgacaggccttcgaatcaggcaccgggcttgcgggtcatgcaccaggtgcgcggtccttcgggcacctcgacgtcggcggtgacggtgaagccgagccgctcgtagaaggggaggttgcggggcgcggaggtctccaggaaggcgggcaccccggcgcgctcggccgcctccactccggggagcacgacggcgctgcccagacccttgccctggtggtcgggcgagacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcctcaggtgcagaggtttctacagggaaagagagaaaggctacagttagtttgctgtgatgatgctaagtgccgaggtcagatgtctatggattgtacacggaatcccaacgcaggaaccaaaaaacactcacccaaaaaaatggcgctaaggccgagagaaaggcgaagttccgtctacggctatataccttgaaacaggggcggcagaagtgacgcaacgcggttgcgcggacggcttcctgtgttttcattggtcgaagcgttctgcgcgtgcgcagagattccccagggaaggcgggccctcttccgaatgtccaatccggacattcttccggttggacctccgcggtcagcgctgtgcccggcgagagatcacgtggggcgcggaggcggtgctgctggggcacggccgtccagcctcggcggccatatttttgaggggctgttcatctcgttcacacgctctgtccgccatgtttgtgagtggaagcgccattaccccttcaagcgactgaaggctgcagggcctctggtggcccgcatggggagaccagacccgccaggcccgcctttccgcactcagtccgggcttactttattttgtgagacagggtctcgcctagaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagatagctgatcacctaaggtacctagcctaggtaagtcgacactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctgggcctactagatagcggaccccttaccgaaacatcgccgcattctgcagaggagtcgaacttagtgtatgtaaacttctgacccactggaattgtgatacagtgaattataagtgaaataatctgtctgtaaacaattgttggaaaaatgacttgtgtcatgcacaaagtagatgtcctaactgacttgccaaaactattgtttgttaacaagaaatttgtggagtagttgaaaaacgagttttaatgactccaacttaagtgtatgtaaacttccgacttcaactgtatagggatcc

SEQ ID NO: 877 - DNA, 1183 bp, Artificial Sequence
  Synthetic Polynucleotide
gtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 878 - DNA, 20 bp, Artificial Sequence
  Synthetic Polynucleotide
taatacgactcactataggg

SEQ ID NO: 879 - DNA, 20 bp, Artificial Sequence
  Synthetic Polynucleotide
attaaccctcactaaaggga

SEQ ID NO: 880 - DNA, 9541 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctagttaagcttgatatcgaattcctgcagcccgggggatctgctagcatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtaggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgagttggaaggatgcctctggatggtcctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgagtcgactccggatgatcagggccctgtacagatatcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 881 - DNA, 7566 bp, Artificial Sequence
  Synthetic Polynucleotide
tgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcccagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccggaattagatccccaccatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagaccgatttctacccctacgatgtgcccgattacgcttagtctagagggccctattctatagtgtcacctaagtcgaggttaacgaattctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcatcccgccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccggggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagagtagatgccgaccgaacaagagctgatttcgagaacgcctcagccagcaactcgcgcgagcctagcaaggcaaatgcgagagaacggccttacgcttggtggcacagttctcgtccacagttcgctaagctcgctcggctgggtcgcgggagggccggtcgcagtgattcaggcccttctggattgtgttggtccccagggcacgattgtcatgcccacgcactcgggtgatctgactgatcccgcagattggagatcgccgcccgtgcctgccgattgggtgcagatccgtcgacctgcagccaagcttatcgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatagttcattatggacagcgcagaagagctggggagaattaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggcgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgattagtccaatttgttaaagacaggatatcagtggtccaggctctagttttgactcaacaatatcaccagctgaagcctatagagtacgagccatagataaaataaaagattttatttagtctccagaaaaaggggggaa

SEQ ID NO: 882 - DNA, 6884 bp, Artificial Sequence
  Synthetic Polynucleotide
tgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcccagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccggaattagatccccaccatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagaccgatttctacccctacgatgtgcccgattacgcttagtctagagggccctattctatagtgtcacctaagtcgaggttaacgaattctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcagcccaagcttaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgcccgccccacgacccgcagcgcccgaccgaaaggagcgcacgaccccatgcatcgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatagttcattatggacagcgcagaagagctggggagaattaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggcgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgattagtccaatttgttaaagacaggatatcagtggtccaggctctagttttgactcaacaatatcaccagctgaagcctatagagtacgagccatagataaaataaaagattttatttagtctccagaaaaaggggggaa

SEQ ID NO: 883 - DNA, 7512 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctagaggatccccaccatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgagttggaaggatgcctctggatggtcttaagtcgagaccgatttctacccctacgatgtgcccgattacgcttagtctagagggcccgcggttcgaaggtaagcctatccctaaccctctcctcggtctcgattctacgcgtaccggttagtaatgagtttggaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 884 - DNA, 7476 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctagaggatccccatggaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagaccgatttctacgactacaaggacgacgatgacaaggattataaagatgatgacgataaagtcgagaccgatttctacgactacaaggacgacgatgacaagtagtctagagggcccgcggttcgaaggtaagcctatccctaaccctctcctcggtctcgattctacgcgtaccggttagtaatgagtttggaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 885 - DNA, 8663 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctagttaagcttgatatcgaattcctgcagcccgggggatctgctagcatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgccactagtggctccggcgagggcagaggaagtctactaacctgcggagatgtggaagaaaatcctggcccacatatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaactcgactccggatgatcagggccctgtacagatatcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 886 - DNA, 7524 bp, Artificial Sequence
  Synthetic Polynucleotide
tgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcccagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgtatcctccctttatccagccctcactccttctctaggcgccggaattagatccccaccatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgagttggaaggatgcctctggatggtcttaagtcgaggttaacgaattctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcatcccgccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagagtagatgccgaccgaacaagagctgatttcgagaacgcctcagccagcaactcgcgcgagcctagcaaggcaaatgcgagagaacggccttacgcttggtggcacagttctcgtccacagttcgctaagctcgctcggctgggtcgcgggagggccggtcgcagtgattcaggcccttctggattgtgttggtccccagggcacgattgtcatgcccacgcactcgggtgatctgactgatcccgcagattggagatcgccgcccgtgcctgccgattgggtgcagatccgtcgacctgcagccaagcttatcgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatagttcattatggacagcgcagaagagctggggagaattaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggcgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgattagtccaatttgttaaagacaggatatcagtggtccaggctctagttttgactcaacaatatcaccagctgaagcctatagagtacgagccatagataaaataaaagattttatttagtctccagaaaaagggggga

SEQ ID NO: 887 - DNA, 7476 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctagaggatccccaccatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagaccgatttctacgactacaaggacgacgatgacaagtagtctagagggcccgcggttcgaaggtaagcctatccctaaccctctcctcggtctcgattctacgcgtaccggttagtaatgagtttggaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 888 - DNA, 2313 bp, Artificial Sequence
  Synthetic Polynucleotide
atggactggatttggcgcatccttttccttgtcggcgctgctaccggcgcccattccgaattcaaagaaaagacccccgaggaacccaaagaagaagtgactattaaggctaatctgatctacgctgacggcaagacacagacagctgagtttaaggggacattcgaagccaccgccgaggcttacagatacgccgatgccctgaaaaaagataatggggagtatacagtggatgtggctgataagggatataccctgaatattaagtttgctgggaaagagaaaacacctgaagaacctaaagaagaagtgacaatcaaagcaaacctgatctatgccgatggaaagacccagactgctgagttcaaaggcacttttgaagaggccactgccgaagcctatcgctatgctgacctgctggctaaagagaacggaaagtacactgtggatgtggcagacaaagggtatactctgaatatcaaattcgccggaaaagagaaaactccagaggaacccaaagaggaggttaccattaaagctaaccttatatatgcggatggcaaaacccagacagccgaatttaaggggactttcgccgaggccacagctgaggcatatagatatgccgatctgctggcaaaagaaaatggcaagtataccgccgacctggaagatggcggctacaccatcaacatccgcttcgccgggaagaaggtggacgagaagcccgaagagaaagaacaagtgactatcaaagagaacatctacttcgaggacggcaccgtgcagaccgccacctttaagggaacctttgccgaggctaccgcagaagcctatagatacgcagacctgctgtccaaagagcatgggaagtatactgctgatctggaagatggggggtatacaatcaatatcagatttgccggcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 889 - DNA, 2547 bp, Artificial Sequence
  Synthetic Polynucleotide
atggccttaccagtgaccgccttgctcctgccgctggccttgctgctccacgccgccaggccggaattcaaagaggaaacccccgagacacccgaaaccgacagcgaggaagaagtgaccatcaaggccaacctgatcttcgccaacggcagcacccagaccgccgagttcaagggcaccttcgagaaggccaccagcgaagcctacgcctacgccgacaccctgaagaaggacaacggcgagtacaccgtggacgtggccgacaagggctacacactgaacatcaagttcgccggcaaagaaaagacccccgaggaacccaaagaagaagtgactattaaggctaatctgatctacgctgacggcaagacacagacagctgagtttaaggggacattcgaagccaccgccgaggcttacagatacgccgatgccctgaaaaaagataatggggagtatacagtggatgtggctgataagggatataccctgaatattaagtttgctgggaaagagaaaacacctgaagaacctaaagaagaagtgacaatcaaagcaaacctgatctatgccgatggaaagacccagactgctgagttcaaaggcacttttgaagaggccactgccgaagcctatcgctatgctgacctgctggctaaagagaacggaaagtacactgtggatgtggcagacaaagggtatactctgaatatcaaattcgccggaaaagagaaaactccagaggaacccaaagaggaggttaccattaaagctaaccttatatatgcggatggcaaaacccagacagccgaatttaaggggactttcgccgaggccacagctgaggcatatagatatgccgatctgctggcaaaagaaaatggcaagtataccgccgacctggaagatggcggctacaccatcaacatccgcttcgccgggaagaaggtggacgagaagcccgaagagaaagaacaagtgactatcaaagagaacatctacttcgaggacggcaccgtgcagaccgccacctttaagggaacctttgccgaggctaccgcagaagcctatagatacgcagacctgctgtccaaagagcatgggaagtatactgctgatctggaagatggggggtatacaatcaatatcagatttgccggcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 890 - DNA, 223 bp, Artificial Sequence
  Synthetic Polynucleotide
gaacgctgacgtcatcaacccgctccaaggaatcgcgggcccagtgtcactaggcgggaacacccagcgcgcgtgcgccctggcaggaagatggctgtgagggacaggggagtggcgccctgcaatatttgcatgtcgctatgtgttctgggaaatcaccataaacgtgaaatgtctttggatttgggaatcttataagttctgtatgagaccactctttccc

SEQ ID NO: 891 - DNA, 278 bp, Artificial Sequence
  Synthetic Polynucleotide
gaacgctgacgtcatcaacccgctccaaggaatcgcgggcccagtgtcactaggcgggaacacccagcgcgcgtgcgccctggcaggaagatggctgtgagggacaggggagtggcgccctgcaatatttgcatgtcgctatgtgttctgggaaatcaccataaacgtgaaatgtctttggatttgggaatcttataagttctgtatgagaccactctttccctgaacctccctgattactatatcaagagtatagtaatcagggaggttcatttttt

SEQ ID NO: 892 - DNA, 7158 bp, Artificial Sequence
  Synthetic Polynucleotide Lentiviral Vector encoding H1 promoter driven shRNA against BRD4.
  misc_feature (3291)..(3294): n is a, c, g, or t
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcnnnngtcgacgaacgctgacgtcatcaacccgctccaaggaatcgcgggcccagtgtcactaggcgggaacacccagcgcgcgtgcgccctggcaggaagatggctgtgagggacaggggagtggcgccctgcaatatttgcatgtcgctatgtgttctgggaaatcaccataaacgtgaaatgtctttggatttgggaatcttataagttctgtatgagaccactctttccctgaacctccctgattactatatcaagagtatagtaatcagggaggttcattttttccggactatagtgtcacctaaatgctagacgtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 893 - DNA, 9803 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgagtcgacgaacgctgacgtcatcaacccgctccaaggaatcgcgggcccagtgtcactaggcgggaacacccagcgcgcgtgcgccctggcaggaagatggctgtgagggacaggggagtggcgccctgcaatatttgcatgtcgctatgtgttctgggaaatcaccataaacgtgaaatgtctttggatttgggaatcttataagttctgtatgagaccactctttccctgaacctccctgattactatatcaagagtatagtaatcagggaggttcattttttccggactatagtgtcacctaaatgctagacgtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 894 - DNA, 9571 bp, Artificial Sequence
  Synthetic Polynucleotide. SIR encoding Lentiviral Vector.
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattggctagcaccatggccttaccagtgaccgccttgctcctgccgctggccttgctgctccacgccgccaggccggaacagaaactcatcagtgaagaagacctggaattccaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgagtcgacggcgaatccggactatagtgtcacctaaatgctagacgtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 895 - DNA, 9211 bp, Artificial Sequence
  Synthetic Polynucleotide. SIR encoding Lentiviral Vector.
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcatggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgagtcgacggcgaatccggactatagtgtcacctaaatgctagacgtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 896 - DNA, 9214 bp, Artificial Sequence
  Synthetic Polynucleotide. SIR encoding Lentiviral Vector.
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcatggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgagtcgacggcgaatccggactatagtgtcacctaaatgctagacgtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 897-899 - skipped (3 entries)

SEQ ID NO: 900 - DNA, 2652 bp, Artificial Sequence
  Synthetic polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctgggcgcgccatggactggatttggcgcatccttttccttgtcggcgctgctaccggcgcgcattccttcgaagaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggcccccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 901 - DNA, 2604 bp, Artificial Sequence
  Synthetic Polynucleotide encoding a SIR
atggactggatttggcgcatccttttccttgtcggcgctgctaccggcgcgcattccttcgaagaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 902 - DNA, 2652 bp, Artificial Sequence
  Synthetic Polynucleotide encoding a SIR
atggccttaccagtgaccgccttgctcctgccgctggccttgctgctccacgccgccaggccggacatccagatgacacagactacatcctcactgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 903 - DNA, 2602 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 904 - DNA, 2568 bp, Artificial Sequence
  Synthetic Polynucleotide encoding a SIR
atggccttaccagtgaccgccttgctcctgccgctggccttgctgctccacgccgccaggccggacatccagatgacacagactacatcctcactgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 905 - DNA, 2454 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 906 - DNA, 2664 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 907 - DNA, 2695 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 908 - DNA, 2577 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 909 - DNA, 2919 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 910 - DNA, 3393 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagcatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 911 - DNA, 2076 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcactcgaggggaaaccaattcccaaccctcttctgggactggattcaaccggcagcggcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 912 - DNA, 2076 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 913 - DNA, 1671 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 914 - DNA, 2166 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcaacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 915 - DNA, 3225 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatgaagtggaaggccctgttcaccgccgccattctccaggcccaactgcctatcacagaggcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagacatatgcgggccaagagatccggtagcggagagggaagaggtagcctcctcacctgtggggacgttgaagagaaccccggcccaggtaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 916 - DNA, 3351 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatgaagtggaaggccctgttcaccgccgccattctccaggcccaactgcctatcacagaggcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagacatatgcgggccaagagatccggtagcggagagggaagaggtagcctcctcacctgtggggacgttgaagagaaccccggcccaggtaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 917 - DNA, 3495 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaacatatgcgggccaagagatccggtagcggagagggaagaggtagcctcctcacctgtggggacgttgaagagaaccccggcccaggtaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 918 - DNA, 3351 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccagtcgagaccgatttctacgactacaaggacgacgatgacaagcatatgcgggccaagagatccggtagcggagagggaagaggtagcctcctcacctgtggggacgttgaagagaaccccggcccaggtaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 919 - DNA, 3363 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatgaagtggaaggccctgttcaccgccgccattctccaggcccaactgcctatcacagaggcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaggcggcggatccaagagaggccggaagaagctgctgtacatcttcaagcagcctttcatgcggcccgtgcagaccacccaggaagaggacggctgctcctgccggttccccgaggaagaagaaggcggctgcgagctgcatatgcgggccaagagatccggtagcggagagggaagaggtagcctcctcacctgtggggacgttgaagagaaccccggcccaggtaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 920 - DNA, 3270 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccagtcgagaccgatttctacgactacaaggacgacgatgacaagcatatgcgggccaagagatccggtagcggagagggaagaggtagcctcctcacctgtggggacgttgaagagaaccccggcccaggtaccatgggcaacgaggccagctaccctctggagatgtgctcccacttcgacgccgacgagatcaagcggctgggcaagcgcttcaagaagctggacctggacaacagcggcagcctgagcgtggaggagtttatgtctctgcccgagctgcagcagaaccccctggtgcagcgcgtgatcgacatcttcgacaccgacggcaacggcgaggtggacttcaaggagttcatcgagggcgtgagccagttcagcgtgaagggcgacaaggagcagaagctgcggttcgccttccgcatctacgatatggataaagatggctatatttctaatggcgagctgttccaggtgctgaagatgatggtgggcaacaataccaagctggccgatacccagctgcagcagatcgtggacaagaccatcatcaacgccgacaaggacggcgacggcagaatcagcttcgaggagttctgtgccgtggtgggaggcctggatattcacaaaaaaatggtggtggacgtgtga

SEQ ID NO: 921 - DNA, 2997 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatggccttaccagtgaccgccttgctcctgccgctggccttgctgctccacgccgccaggccggacgaattcgaggtgcagctggtagaatccggcgggggacttgtacaggctggtggtagtctgagactgagctgtgtggcctccggcatcagcagcagcaagcggaacatgggatggtataggcaagcccctggtaagcagagggaatccgtggctacaatcagcagcggcggcaacaaggactacaccgacgccgtgaaggacaggttcaccatctccagggacaccaccaagaacaccgtgtacctgcagatgaactccctcaagcccgaggacaccgccgtgtactactgcaagatcgaggccggcacaggctgggccaccagaagaggctacacatactgggggcagggaacactggtgaccgtgagctccggatccaaagagagcagcggcggacccgacagccctgatacagagcctggaagctctgccggacctacccagaggcccagcgacaacagccacaatgaacacgcccctgccagccagggactgaaggccgagcacctgtacatcctgatcggcgtgtccgtggtgttcctgttctgcctgctgctgctggtgctgttctgtctgcaccggcagaaccagatcaagcagggacctcccagaagcaaggacgaggaacagaagcctcagcagaggcccgacctggccgtggacgtgctggaaagaacagccgacaaggccaccgtgaacggcctgcccgagaaggacagagagacagacacaagcgccctggccgctggcagctctcaggaagtgacatacgcccagctggaccactgggctctgacccagagaacagccagagccgtgtccccccagagcaccaaacctatggccgagagcatcacctacgccgccgtggctagacaccatatgtga

SEQ ID NO: 922 - DNA, 2649 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 923 - DNA, 2649 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 924 - DNA, 2613 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 925 - DNA, 2649 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 926 - DNA, 2859 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 927 - DNA, 2649 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 928 - DNA, 2649 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 929 - DNA, 2613 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 930 - DNA, 2649 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 931 - DNA, 2640 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 932 - DNA, 2568 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 933 - DNA, 2568 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 934 - DNA, 2568 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 935 - DNA, 2568 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 936 - DNA, 2652 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 937 - DNA, 2640 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggaacagaaattgataagtgaggaagacttgggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 938 - DNA, 2640 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgagggaggctggtcccatccccagttcgagaaaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 939 - DNA, 2544 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggacctgaagaacgtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgagagctaccagcagggcgtgctgtctgccaccatcctgtacgagatcctgctgggcaaggccaccctgtacgccgtgctggtgtccgccctggtgctgatggctatggtgaagcggaaggacttcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtcctgatcctgccgtgtaccagctgcgggatagcaagagcagcgacaagagcgtgtgcctgttcaccgacttcgacagccagaccaacgtgtctcagtctaaggatagtgatgtgtatatcaccgacaagaccgtgctggacatgcggagcatggacttcaagagcaacagcgccgtggcctggtccaacaagagcgacttcgcctgcgccaacgccttcaacaacagcatcatccccgaggacaccttcttccccagccccgagagcagctgcgacgtgaaactggtggagaagagcttcgagacagacaccaacctgaacttccagaacctgagcgtgatcggcttcagaatcctgctgctgaaggtggccggcttcaacctgctgatgaccctgcggctgtggagcagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 940 - DNA, 2544 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggacctgaacaaggtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgtgagctaccagcagggcgtgctgtctgccaccatcctgtacgagatcctgctgggcaaggccaccctgtacgccgtgctggtgtccgccctggtgctgatggctatggtgaagcggaaggacttcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtcctgatcctgccgtgtaccagctgcgggatagcaagagcagcgacaagagcgtgtgcctgttcaccgacttcgacagccagaccaacgtgtctcagtctaaggatagtgatgtgtatatcaccgacaagaccgtgctggacatgcggagcatggacttcaagagcaacagcgccgtggcctggtccaacaagagcgacttcgcctgcgccaacgccttcaacaacagcatcatccccgaggacaccttcttccccagccccgagagcagctgcgacgtgaaactggtggagaagagcttcgagacagacaccaacctgaacttccagaacctgagcgtgatcggcttcagaatcctgctgctgaaggtggccggcttcaacctgctgatgaccctgcggctgtggagcagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 941 - DNA, 3003 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtgtggggcgagggcagctacctgagcagctaccctacatgccctgcccaggcttggtgcagcagaagcgcactgagagcacccagctctagcctgggagccttctttgccggcgatctgcctccaccactccaggctggcgctgctcgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 942 - DNA, 2859 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 943 - DNA, 2595 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 944 - DNA, 2595 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 945 - DNA, 2559 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 946 - DNA, 2595 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 947 - DNA, 2949 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtgtggggcgagggcagctacctgagcagctaccctacatgccctgcccaggcttggtgcagcagaagcgcactgagagcacccagctctagcctgggagccttctttgccggcgatctgcctccaccactccaggctggcgctgctcgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 948 - DNA, 2805 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 949 - DNA, 2670 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 950 - DNA, 2688 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 951 - DNA, 2649 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 952 - DNA, 2631 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 953 - DNA, 2619 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggatctgcggaacgtgaccccacccaaggtgtccctgttcgagcccagcaaggccgagatcgccaataaacagaaggccaccctcgtgtgcctggccagaggcttcttccccgaccacgtggaactgtcttggtgggtcaacggcaaagaggtgcacagcggcgtcagcaccgaccctcaggcctacaaagagagcaactacagctactgcctgagcagtcggctgcgggtgtccgccaccttctggcacaacccccggaaccacttcagatgccaggtgcagttccacggcctgagcgaagaggacaagtggcccgagggcagccccaagcctgtcacccagaacatcagcgccgaggcctggggcagagcctgtggcatcaccagcagctaccagcagggcgtgctgagcgccaccatcctgtacgagatcctgctgggcaaggccaccctgtacgccgtgctggtgtccaccctggtggtcatggctatggtcaagcggaagaacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgaacctgccgtgtaccagctgaaggaccccagaagccaggacagcaccctgtgcctgttcaccgacttcgacagccagatcaacgtgcccaagacaatggaaagcggcaccttcatcaccgacaagaccgtgctggacatgaaggctatggacagcaagagcaacggcgccattgcctggtccaaccagaccagcttcacatgccaggacatcttcaaagagacaaacgccacctacccctccagcgacgtgccctgtgacgccaccctgaccgagaagtccttcgagacagacatgaacctcaacttccagaacctgagcgtgatgggcctgcgaatcctgctgctgaaagtggccggcttcaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 954 - DNA, 2532 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggacctccagaaagtgaccccccctaccgtgaccgtgttcgagccttctgaggccgagatcagccggacccagaaagccacactcgtgtgcctggctcggggcttctaccccgatcacgtggaactgtcttggtgggtcaacggcaaagaagtgaccagcggcttcagcaccgacccccagcctgacaaagagcggcccagcgagaacgacagcagctactgcctgagcagcagactgagagtgtccgccagcttctggcacaacccccggaaccacttcagatgccaggtgcagttctacggcctgggcgacgacgacgagtggaagtacgacagagtgaagcccatcacccagaacatcagcgccgaagcctggggcagagccgattgcggctttacctccgtcagctaccaccagggcgtgctgagcgccaccatcctgtacgagatcctgctgggcaaggccaccctgtacgccgtgctggtgtctatcctggtgctgatggctaaagtgaagcggaagggcagcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgtgcaggaccctgaccctagcgtgtaccagatgagaagccccaagaccggcaggaccgtgtgcctgttcaccgacttcgacagccaggccgacttccagaagcctgagggggccaccgtgatctccctgaacagcaccgtgctggacatgaaagtgatggacagcaagagcaacggcgctctgacctggaacagcgagacaaacatcgagtgcaaagagaacttccagcagcccttctaccccagcagcaactactcctgcgacgccaagctgatcgagaagtccttcgagacagacatggacctgaacttctacaacctgctggtcatcggcctgagaatcctgctgctgaaagtgatcggcttcaacctgttcatgaccctgaggctgtggtcctgccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 955 - DNA, 2640 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggtctggaggcggaggcagcggcggaggcgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtggcagcggcggaggcggaagtggaggcggaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 956 - DNA, 2670 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccagtcgagaccgatttctacgactacaaggacgacgatgacaagcatatgtga

SEQ ID NO: 957 - DNA, 2814 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaacatatgtga

SEQ ID NO: 958 - DNA, 2664 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatgaagtggaaggccctgttcaccgccgccattctccaggcccaactgcctatcacagaggcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagatga

SEQ ID NO: 959 - DNA, 2676 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatgaagtggaaggccctgttcaccgccgccattctccaggcccaactgcctatcacagaggcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaggcggcggatccaagagaggccggaagaagctgctgtacatcttcaagcagcctttcatgcggcccgtgcagaccacccaggaagaggacggctgctcctgccggttccccgaggaagaagaaggcggctgcgagctgtga

SEQ ID NO: 960 - DNA, 2538 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatgaagtggaaggccctgttcaccgccgccattctccaggcccaactgcctatcacagaggcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagatga

SEQ ID NO: 961 - DNA, 2841 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgatcgagacatacaaccagaccagccccagaagcgccgccaccggactgcccatcagcatgaagattttcatgtacctgctgaccgtgttcctgattacccagatgatcggcagcgccctgttcgccgtgtacctgcacagacggctggacaagatcgaggacgagcggaacctgcacgaggacttcgtgtttatgaagaccatccagcggtgcaacaccggcgagagaagcctgagcctgctgaactgcgaggaaatcaagagccagttcgagggcttcgtgaaggacatcatgctgaacaaagaggaaactaagaaagaaaacagcttcgagatgcagaagggcgaccagaacccccagattgccgcccacgtgatctctgaggccagcagcaagaccacctccgtgctccagtgggccgagaagggctactacaccatgagcaacaacctcgtgaccctggaaaacggcaagcaactgaccgtgaagcggcagggcctgtactacatctacgcccaagtgaccttctgctccaacagagaggccagctcccaggccccctttatcgccagcctgtgcctgaagtcccccggcagattcgagagaatcctgctgagagccgccaacacccacagcagcgccaagccttgtggacagcagagcatccacctgggcggcgtgttcgagcttcagcctggcgcttccgtgttcgtgaacgtgaccgaccctagccaggtgtcccacggcaccggctttaccagcttcggactgctgaagctgtga

SEQ ID NO: 962 - DNA, 2688 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatgtcgagaccgatttctacgactacaaggacgacgatgacaagtga

SEQ ID NO: 963 - DNA, 3003 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccagtcgagaccgatttctacgactacaaggacgacgatgacaagtga

SEQ ID NO: 964 - DNA, 3324 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccagtcgagaccgatttctacgactacaaggacgacgatgacaagtga

SEQ ID NO: 965 - DNA, 3126 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggcgcactttccgggctttggacagtcactcctgtacggctatcccgtctatgtattcggtgattgtgtgcaagccgattggtgtccagtgtccggtggtctgtgcagtacacggcttcaccggcacgccctgctggcaacttgccccgaacaccagcttacatgggacccaatcgacggtcgcgtagtgtcttctcccctccagtatctgattcctagattgccttcctttccaacacagaggaccagccggaccctgaaggttctgaccccaccgactacaccagtgtcccccaaagtgcctcccgccttcttccaaagtatgagaaaacatactccctataggaatggctgcttggagccaaccctcggtgaccaactcccctcactcgccttccccgaacctggcctgcgcccacagaacatctatactacttggggcaagactgtggtatgcctttacctgtaccagctgagtcccccgatgacatggcccctcatcccccacgtcattttctgtcacccacggcagctgggagcgttccttaccaaagttccgctcaaacgcctggaggaactgctgtataagatgtttctgcacactggtgccgtgatcgtgctgcccgaggacgatctgcccaccacaatgttccagccggtgcgggctccttgcatccagactgcttggtgcacaggccttctgccttaccactccatactcacaacccctggtctgatctggaccttcaatgacggaagccctatgatttcaggaccttgtcccaaggctggacagccatctctggttgtgcagtcatctctgctcatcttcgagaaattccaaaccaaggcctttcatccatcctacctcctctcccatcagctgatacagtacagctccttccacaacttgcacctgctctttgatgaatatacgaatattccagtcagcatactcttcaacaagggcgaggccgatgataatggcgaccagccgcctgagcctgccgcacagggtgaaagctccacacagaaggtgcggccctcccatactaacaatccaaagtga

SEQ ID NO: 966 - DNA, 3126 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggcgcactttccgggctttggacagtcactcctgtacggctatcccgtctatgtattcggtgattgtgtgcaagccgattggtgtccagtgtccggtggtctgtgcagtacacggcttcaccggcacgccctgctggcaacttgccccgaacaccagcttacatgggacccaatcgacggtcgcgtagtgtcttctcccctccagtatctgattcctagattgccttcctttccaacacagaggaccagccggaccctgaaggttctgaccccaccgactacaccagtgtcccccaaagtgcctcccgccttcttccaaagtatgagaaaacatactccctataggaatggctgcttggagccaaccctcggtgaccaactcccctcactcgccttccccgaacctggcctgcgcccacagaacatctatactacttggggcaagactgtggtatgcctttacctgtaccagctgagtcccccgatgacatggcccctcatcccccacgtcattttctgtcacccacggcagctgggagcgttccttaccaaagttccgctcaaacgcctggaggaactgctgtataagatgtttctgcacactggtgccgtgatcgtgctgcccgaggacgatctgcccaccacaatgttccagccggtgcgggctccttgcatccagactgcttggtgcacaggccttctgccttaccactccatactcacaacccctggtctgatctggaccttcaatgacggaagccctatgatttcaggaccttgtcccaaggctggacagccatctctggttgtgcagtcatctctgctcatcttcgagaaattccaaaccaaggcctttcatccatcctacctcctctcccatcagctgatacagtacagctccttccacaacttgcacctgctctttgatgaatatacgaatattccagtcagcagaagcttcaacaagggcgaggccgatgataatggcgaccagccgcctgagcctgccgcacagggtgaaagctccacacagaaggtgcggccctcccatactaacaatccaaagtga

SEQ ID NO: 967 - DNA, 3258 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgctggaaggcgtgcaggtggaaaccatcagccctggcgacggcagaaccttccctaagaggggccagacctgcgtggtgcactacaccggaatgctggaagatggcaagaaggtggacagcagccgggaccggaacaagcccttcaagttcatgctgggcaagcaggaagtgatccggggctgggaagagggcgtggcccagatgtctgtgggccagagagccaagctgaccatctcccccgattacgcctacggcgctacaggccaccctggcatcattcctccacacgccacactggtgttcgacgtggaactgctgaagctggaaagcggcggaggcagcggagtggatggcttcggagatgtgggagccctggaaagcctgagaggcaacgccgacctggcctacatcctgagcatggaaccttgcggccactgcctgattatcaacaacgtgaacttctgccgcgagagcggcctgagaaccagaaccggcagcaacatcgactgcgagaagctgcggcggagattcagcagcctgcacttcatggtggaagtgaagggcgacctgaccgccaagaaaatggtgctggccctgctggaactggcccagcaggatcatggcgctctggactgctgtgtggtcgtgatcctgagccacggctgccaggcttcccatcttcagttccctggcgctgtgtacggcaccgatggctgtcctgtgtccgtggaaaagatcgtgaacatcttcaacggcaccagctgccccagcctgggcggaaagcccaagctgttctttattcaagcctgtggcggcgagcagaaggaccacggctttgaggtggcctccaccagccctgaggatgagagccctggcagcaaccctgagcctgacgccaccccattccaggaaggactgcggaccttcgaccagctggacgccatctctagcctgcccacccccagcgacatcttcgtgtcctacagcaccttccccggctttgtgtcctggcgggaccctaagagcggctcttggtacgtggaaaccctggacgacatctttgagcagtgggctcacagcgaggacctccagagcctgctgctgagagtggctaacgccgtgtccgtgaagggcatctacaagcagatgcctggctgcttcaacttcctgcggaagaagctgtttttcaagaccagctga

SEQ ID NO: 968 - DNA, 2868 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggattggatatggaggatactttttctcgtgggggcagcaaccggggctcattccgaggttcagttggtcgaatcaggcgggggcctcgtccaacccggcggaagcctgcggctgtcttgcgcagcaagtggtagtgtgttcaagatcaacgttatggcctggtatcgccaggctccgggaaaagggagagagctggttgcggggatcattagcggtggctccaccagctacgctgacagtgtgaagggaaggttcactatatcacgcgacaacgcaaagaatacattgtacctccagatgaatagcttgcggcccgaagacacggcagtctactattgtgcctttatcacaacagagagcgactatgacctgggccgccggtattgggggcagggaacccttgtgaccgtttcatccggcggaggcggaagtggaggcggaggatctggcggcggaggctctgaggtgcagctcgtggaatcaggcggaggtcttgtacagccaggaaattctcttcggctgtcttgcgccgcgagcgggttcaccttcagcagcttcggaatgagctgggtaagacaggcaccggggaaaggcctggagtgggtgagctcaatcagtgggagcgggtcagataccctgtacgcggattccgtgaagggcagattcacaatctctcgggacaatgctaagacaacactttaccttcagatgaactctctgcgacccgaggataccgctgtctactactgtacaataggaggttctctgtccagaagttctcaagggacactggtgaccgtctccagctga

SEQ ID NO: 969 - DNA, 3678 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgtgccatcagcagctcgtgattagctggttcagcctggtgttcctggcctcccccctggtggctatctgggagctgaagaaagacgtgtacgtggtggaactggactggtatcccgacgcccctggcgagatggtggtgctgacctgcgatacccccgaagaggacggcatcacctggaccctggatcagagcagcgaggtgctgggcagcggcaagaccctgaccatccaagtgaaagagttcggcgacgccggccagtacacctgtcacaagggcggagaggtgctgagccacagcttgctgctgctgcacaagaaagaggatggcatttggagcaccgacatcctgaaggaccagaaagagcccaagaacaagaccttcctgagatgcgaggccaagaactacagcggcagattcacctgttggtggctgaccaccatcagcaccgacctgaccttcagcgtgaagtccagcagaggcagcagcgaccctcagggcgtgacatgtggcgctgctacactgagcgccgagagagtgcggggcgacaacaaagaatacgagtacagcgtggaatgccaggaagatagcgcctgccctgccgccgaggaaagcctgcctatcgaagtgatggtggacgccgtgcacaagctgaagtacgagaactacaccagcagctttttcatccgggacatcatcaagcccgacccccccaagaacctccagctgaagcccctgaagaacagcagacaggtggaagtgtcctgggagtaccccgacacctggtccaccccccacagctacttcagcctgacattctgtgtgcaagtgcagggcaagtccaagcgcgagaaaaaggaccgggtgttcaccgacaagaccagcgccaccgtgatctgccggaagaacgccagcatcagcgtgcgcgcccaggatcggtactacagcagctcttggagcgagtgggccagcgtgccatgttctggcggcggaggatctgggggaggcggaagcggagggggaggatctaggaatctgcccgtggctacccccgaccccggcatgtttccttgtctgcaccacagccagaacctgctgcgggccgtgtccaacatgctccagaaggccagacagaccctggagttctacccctgcaccagcgaggaaatcgaccacgaggacatcaccaaggataagaccagcaccgtggaagcctgtctgcccctggaactgaccaagaacgagagctgcctgaacagccgggaaaccagcttcatcaccaacggctcttgcctggcttccagaaagacctccttcatgatggccctgtgcctgagcagcatctacgaggacctgaagatgtaccaggtggagttcaagaccatgaacgccaaactgctgatggaccccaagaggcagattttcctggaccagaatatgctggccgtgatcgacgagctgatgcaggccctgaacttcaacagcgagacagtgccccagaagtcctccctggaagaacccgacttctacaagaccaagatcaagctgtgcatcctgctgcacgccttcagaatccgggccgtgaccatcgacagagtgatgagctacctgaacgcctcctga

SEQ ID NO: 970 - DNA, 2823 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgtccgactccaaggaggtccctagccttccatttttgcgacacttgctcgaagagttggacagccatgaggacagcttgctgctgtttctgtgtcacgacgcggccccgggctgcacgacggtcacgcaagctttgtgctcgcttagccaacagcgcaagctgaccctcgcggctctggtcgagatgctctacgtgctgcagcgtatggatcttctcaagagccgcttcgggctcagcaaggagggggccgagcaattgctgggcacaagctttctcacgcgctaccgcaagctcatggtttgcgtgggtgaggagctcgactcgagcgagctacgcgctctacgcttgttcgcgtgcaacctgaatccgagcctgagcacggcgctttctgagagcagccgctttgtcgagcttgtactcgcgcttgaaaacgtaggactcgtctcgccatcgagtgtttccgtgcttgcggacatgttgcgcactcttcggcgcctcgatttgtgccagcagcttgttgagtacgaacaacaagagcaagccaggtaccgttactgttacgcggcctcgccctcattgccagttcgtacgttacgtcgggggcacggcgcgagtgaacacgagcagctgtgcatgcccgtgcaagaatcctctgacagccccgagctgctgcgcacgcccgtacaagaatcctccagcgacagccccgagcaaacgactgtcgagaccgatttctacgactacaaggacgacgatgacaagtga

SEQ ID NO: 971 - DNA, 2796 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggccctgcctgtgacagctctgctgctgcctctggcactgctgctgcacgccgccagacctgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcgaggacttcgccgtgtactactgccagcagagcaccttcggccagggcaccaaggtggaaatcaagggcggaggcggatctggcggcggaggatctgggggaggcggctctcaggtgtacctggtggaaagcggagggggcgtggtgcagcctggaagaagcctgagactgagctgtgccgccagcggcttcaccttcagcaactacggaatgcactgggtgcgccaggcccctggcaaaggactggaatgggtggccctgatttggtacgacggcagcaacaagtattacgccgacagcgtgaagggccggttcaccatcagccgggacaacagcaagaacaccctgtacctccagatgaccagcctgcgggtggaagataccgccgtgtattattgcgccagcaacgtggaccactggggccagggaacactcgtgaccgtgtctagctga

SEQ ID NO: 972 - DNA, 2817 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggcgggatccacatggccctgcctgtgacagctctgctgctgcctctggcactgctgctgcacgccgccagacctgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcgaggacttcgccgtgtactactgccagcagagcaccttcggccagggcaccaaggtggaaatcaagggcggaggcggatctggcggcggaggatctgggggaggcggctctcaggtgtacctggtggaaagcggagggggcgtggtgcagcctggaagaagcctgagactgagctgtgccgccagcggcttcaccttcagcaactacggaatgcactgggtgcgccaggcccctggcaaaggactggaatgggtggccctgatttggtacgacggcagcaacaagtattacgccgacagcgtgaagggccggttcaccatcagccgggacaacagcaagaacaccctgtacctccagatgaccagcctgcgggtggaagataccgccgtgtattattgcgccagcaacgtggaccactggggccagggaacactcgtgaccgtgtctagctga

SEQ ID NO: 973 - DNA, 2817 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggccctgcctgtgacagctctgctgctgcctctggcactgctgctgcacgccgccagacctgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacctttggacagggcaccaaggtggaaatcaagggcggaggcggatctggcggcggaggatctgggggaggcggctctcaggtgcagctggtggaaagtgggggaggatggcagcctggcagaagcctgagactggactgcaaggccagcggcatcaccttcagcaacagcggaatgcactgggtgcgccaggcccctggaaagggactggaatgggtggccgtgatctatgacggcagcaagcggtactacgccgacagcgtgaagggccggttcatcagccgggacaacagcaagaataccctgttcctccagatgaacagcctgcgggccgaggacacagccgtgtattattgcgccaccaacgacgactactggggccagggaacactcgtgaccgtgtcctcttga

SEQ ID NO: 974 - DNA, 3330 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgcgaccctccgggacggccggggcagcgttcctggcgctgctggctgcgctctgcccggcgagtcgggctctggaggaaaagaaaggtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagccttga

SEQ ID NO: 975 - DNA, 3129 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgctgctgctcgtgaccagcctgctgctgtgcgaactgccccaccctgcctttctgctgatcccccggaaagtgtgcaacggcatcggcatcggagagttcaaggacagcctgagcatcaacgccaccaacatcaagcacttcaagaactgcaccagcatcagcggcgacctgcacatcctgcccgtggcctttagaggcgacagcttcacccacacccccccactggaccctcaggaactggacatcctgaaaaccgtgaaagagatcaccggatttctgctgattcaggcttggcccgagaaccggaccgatctgcacgccttcgagaacctggaaatcatccggggcaggaccaagcagcacggccagttttctctggccgtggtgtccctgaacatcaccagcctgggcctgcggagcctgaaagaaatcagcgacggggatgtgattatcagcggcaacaagaacctgtgctacgccaacaccatcaactggaagaagctgttcggcacctccggccagaaaacaaagatcatcagcaaccggggcgagaacagctgcaaggccacaggacaagtgtgccacgccctgtgtagccctgagggctgttggggacccgagcccagagattgcgtgtcctgccggaatgtgtccagaggccgcgagtgcgtggacaagtgcaacctgctggaaggcgagccccgcgagtttgtggaaaacagcgagtgcatccagtgccaccccgagtgtctgccccaggccatgaatatcacctgtaccggcagaggccccgacaactgtatccagtgcgcccactacatcgacggcccccactgcgtgaaaacctgtccagctggcgtgatgggagagaacaacaccctcgtgtggaagtacgccgacgccggccatgtgtgccacctgtgtcaccccaactgcacctacggctgtacaggccctggcctggaaggctgccctaccaacggacccaagatccccagcattgccaccggcatggtgggagcattgctgctgctgctggtggtggccctgggcatcggcctgtttatgtga

SEQ ID NO: 976 - DNA, 3057 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgccccctcccagactgctgttcttcctgctgttcctgacccctatggaagtgcggcccgaggaacccctggtcgtgaaagtggaagagggcgacaacgccgtgctccagtgtctgaagggcacctccgatggccctacccagcagctgacatggtccagagagagccccctgaagcccttcctgaagctgtctctgggcctgcctggcctgggcatccacatgaggccactggctatctggctgttcatcttcaacgtgtcccagcagatgggcggcttctacctgtgtcagcctggccccccaagcgagaaagcctggcagcctggctggaccgtgaacgtggaaggatctggcgagctgttccggtggaacgtgtccgatctgggcggcctgggatgcggcctgaagaacagaagcagcgaaggccccagcagccccagcggcaaactgatgagccccaagctgtacgtgtgggccaaggaccggcccgagatttgggaaggcgagcctccttgcctgccccccagagatagcctgaaccagagcctgagccaggacctgacaatggcccctggcagcacactgtggctgagctgtggcgtgccacccgactctgtgtccagaggccctctgagctggacccacgtgcaccccaagggacctaagagcctgctgagcctggaactgaaggacgacagacccgccagagatatgtgggtcatggaaaccggcctgctgctgcctagagccacagcccaggatgccggcaagtattactgccaccggggcaacctgaccatgagcttccacctggaaatcaccgccagacccgtgctgtggcactggctgctgagaaccggcggatggaaagtgtccgccgtgaccctggcctacctgatcttctgcctgtgctccctcgtgggcatcctgcatctccagcgggctctggtgctgcggcggaagagaaagagaatgaccgaccccacccggcggttctga

SEQ ID NO: 977 - DNA, 2304 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgattctctggacctgtttgggactgagcttaataatttctttggcagttttcgtgctaatgtttttgctaaggaagataaactcttga

SEQ ID NO: 978 - DNA, 3186 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggccctgcctgtgacagctctgctgctgcctctggcactgctgctgcacgccgccagacctgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcgaggacttcgccgtgtactactgccagcagagcaccttcggccagggcaccaaggtggaaatcaagggcggaggcggatctggcggcggaggatctgggggaggcggctctcaggtgtacctggtggaaagcggagggggcgtggtgcagcctggaagaagcctgagactgagctgtgccgccagcggcttcaccttcagcaactacggaatgcactgggtgcgccaggcccctggcaaaggactggaatgggtggccctgatttggtacgacggcagcaacaagtattacgccgacagcgtgaagggccggttcaccatcagccgggacaacagcaagaacaccctgtacctccagatgaccagcctgcgggtggaagataccgccgtgtattattgcgccagcaacgtggaccactggggccagggaacactcgtgaccgtgtctagcggcggaggcggaagtggaggcggaggatctggcggcggaggctctgaggtgcagctcgtggaatcaggcggaggtcttgtacagccaggaaattctcttcggctgtcttgcgccgcgagcgggttcaccttcagcagcttcggaatgagctgggtaagacaggcaccggggaaaggcctggagtgggtgagctcaatcagtgggagcgggtcagataccctgtacgcggattccgtgaagggcagattcacaatctctcgggacaatgctaagacaacactttaccttcagatgaactctctgcgacccgaggataccgctgtctactactgtacaataggaggttctctgtccagaagttctcaagggacactggtgaccgtctccagctga

SEQ ID NO: 979 - DNA, 3435 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatgggcagcagcaagagcaagcctaaggaccccagccagagactgaatgctgctggtggacctggcgctggatctgctgctcctgtgtctagcacaagcagcctgcctctggccgctctgaacatgagagtcagaagaaggctgagcctgttcctgaacgtgcggacacaggtggccgctgattggacagctctggccgaggaaatggacttcgagtacctggaaatccggcagctggaaacccaggccgatcctacaggcagactgctggatgcttggcaaggcagaccaggcgcttctgtggggagactgcttgacctgctgacaaagctgggcagagatgacgtgctgctggaactgggacccagcatcgaggaagattgccagaagtacatcctgaagcagcaacaagaagaggccgagaagcctctgcaggttgccgccgtggatagcagcgttccaagaacagctgagctggccggcatcaccacactggatgatcctctgggacacatgcccgagagattcgacgccttcatctgctactgccccagcgacatcgtgggcaagaagcccacaaacaaggcccctcatcctaagcaagagccccaagagatcaacttccccgacgatctgcccggcagcaatactgctgcacccgtgcaagaaaccctgcacggttgtcagcccgtgacacaagaggacggcaaagaaagccggatctccgtccaagagcggcaagttggcggagtgcaggtcgagacaatctctcctggcgacggcagaacattccccaagaggggacagacctgctggcactacaccggaatgctggaagatggcaagaaggtggacagcagccgggacagaaacaagcccttcaagttcatgctgggcaagcaagaagtgattcgcggctgggaagagggcgtcgcacagatgtctgttggacagagagccaagctgacaatcagccccgactacgcctatggcgctacaggacaccctggcatcattcctccacacgccacactggtgttcgacgtggaactgctgaagctggaagtcggaggcgtccaggtggaaaccatcagtccaggcgacggacggacctttcctaagagaggccagacttgttggcattatacagggatgcttgaggacgggaagaaagtggactcctccagagatcggaacaagccgtttaagtttatgctcggaaaacaagaagtcataagaggctgggaagagggtgttgcccaaatgagcgtgggccagcgcgccaaactgaccatctctccagattatgcctacggcgcaaccggccatccaggcattattccacctcatgctaccctggtgtttgatgtcgagctgctcaaactggaatga

SEQ ID NO: 980 - DNA, 2847 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggccctgcctgtgacagctctgctgctgcctctggcactgctgctgcacgccgccagacctgagatcgtgctgacacagagccctggcacactgtcactgtctccaggcgaaagagccacactgagctgtagagcctctcagagcgtgggcagctcttacctggcttggtatcagcagaagcccggacaggctcccagactgctgatctacggcgctttcagcagagccacaggcatccccgatagattttctggcagcggctccggcaccgacttcaccctgacaatcagcagactggaacccgaggacttcgccgtgtactactgtcagcagtacggcagcagcccttggacctttggacagggcaccaaggtggaaatcaagagaggcggaggcggaagtggaggcggaggatctggcggcggaggctctcaagtgcagctggttgaatcaggtggcggcgttgtgcagcctggcagaagtctgagactgtcttgtgccgccagcggcttcaccttcagcagctacacaatgcactgggtccgacaggcccctggcaaaggactggaatgggtcacctttatcagctacgacggcaacaacaagtattacgccgacagcgtgaagggcagattcaccatctccagagacaacagcaagaacaccctgtacctccagatgaacagcctgagagccgaggacaccgccatctactactgcgccagaacaggatggctgggacccttcgattattggggccagggcacactcgtgaccgtgtcatcttga

SEQ ID NO: 981 - DNA, 3237 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggccctgcctgtgacagctctgctgctgcctctggcactgctgctgcacgccgccagacctgagatcgtgctgacacagagccctggcacactgtcactgtctccaggcgaaagagccacactgagctgtagagcctctcagagcgtgggcagctcttacctggcttggtatcagcagaagcccggacaggctcccagactgctgatctacggcgctttcagcagagccacaggcatccccgatagattttctggcagcggctccggcaccgacttcaccctgacaatcagcagactggaacccgaggacttcgccgtgtactactgtcagcagtacggcagcagcccttggacctttggacagggcaccaaggtggaaatcaagagaggcggaggcggaagtggaggcggaggatctggcggcggaggctctcaagtgcagctggttgaatcaggtggcggcgttgtgcagcctggcagaagtctgagactgtcttgtgccgccagcggcttcaccttcagcagctacacaatgcactgggtccgacaggcccctggcaaaggactggaatgggtcacctttatcagctacgacggcaacaacaagtattacgccgacagcgtgaagggcagattcaccatctccagagacaacagcaagaacaccctgtacctccagatgaacagcctgagagccgaggacaccgccatctactactgcgccagaacaggatggctgggacccttcgattattggggccagggcacactcgtgaccgtgtcatctggcggaggcggaagtggaggcggaggatctggcggcggaggctctgaggtgcagctcgtggaatcaggcggaggtcttgtacagccaggaaattctcttcggctgtcttgcgccgcgagcgggttcaccttcagcagcttcggaatgagctgggtaagacaggcaccggggaaaggcctggagtgggtgagctcaatcagtgggagcgggtcagataccctgtacgcggattccgtgaagggcagattcacaatctctcgggacaatgctaagacaacactttaccttcagatgaactctctgcgacccgaggataccgctgtctactactgtacaataggaggttctctgtccagaagttctcaagggacactggtgaccgtctccagctga

SEQ ID NO: 982 - DNA, 2898 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatggccttaccagtgaccgccttgctcctgccgctggccttgctgctccacgccgccaggccgggctggtttctggacagccctgacagaccctggaatcctccaacattcagccccgctctgctggtggttaccgagggcgataatgccaccttcacctgtagcttcagcaacaccagcgagagcttcgtgctgaactggtacagaatgagccccagcaaccagaccgacaagctggccgcctttcctgaggatagaagccagcctggacaggactgccggttcagagttacccagctgcctaacggcagagacttccacatgagcgttgtgcgggccagaagaaacgacagcggcacatatctgtgcggagccatctctctggcccctaaggctcagatcaaagagagcctgagagccgagctgagagtgacagaaagacgggccgaagtgcccacagctcacccttcaccttctccaagacctgccggccagttccagggatccgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgtga

SEQ ID NO: 983 - DNA, 3234 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatggccttaccagtgaccgccttgctcctgccgctggccttgctgctccacgccgccaggccgggctggtttctggacagccctgacagaccctggaatcctccaacattcagccccgctctgctggtggttaccgagggcgataatgccaccttcacctgtagcttcagcaacaccagcgagagcttcgtgctgaactggtacagaatgagccccagcaaccagaccgacaagctggccgcctttcctgaggatagaagccagcctggacaggactgccggttcagagttacccagctgcctaacggcagagacttccacatgagcgttgtgcgggccagaagaaacgacagcggcacatatctgtgcggagccatctctctggcccctaaggctcagatcaaagagagcctgagagccgagctgagagtgacagaaagacgggccgaagtgcccacagctcacccttcaccttctccaagacctgccggccagttccagggatccgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 984 - DNA, 3234 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaaggatccgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 985 - DNA, 2994 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcggatccaaagagagcagcggcggacccgacagccctgatacagagcctggaagctctgccggacctacccagaggcccagcgacaacagccacaatgaacacgcccctgccagccagggactgaaggccgagcacctgtacatcctgatcggcgtgtccgtggtgttcctgttctgcctgctgctgctggtgctgttctgtctgcaccggcagaaccagatcaagcagggacctcccagaagcaaggacgaggaacagaagcctcagcagaggcccgacctggccgtggacgtgctggaaagaacagccgacaaggccaccgtgaacggcctgcccgagaaggacagagagacagacacaagcgccctggccgctggcagctctcaggaagtgacatacgcccagctggaccactgggctctgacccagagaacagccagagccgtgtccccccagagcaccaaacctatggccgagagcatcacctacgccgccgtggctagacactag

SEQ ID NO: 986 - DNA, 2883 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatggcctgtctgggcttccagagacacaaggcccagctcaacctggctaccagaacctggccttgtactctgctgttcttcctgctgttcatccccgtgttctgcaaggccatgcatgtggctcagcctgctgtggtgctggcctctagtagaggaatcgccagcttcgtgtgcgagtacgcctctcctggaaaggccactgaagtgcgcgtgaccgttctgagacaggccgatagccaagtgaccgaagtgtgcgccgccacctacatgatgggcaacgagctgaccttcctggacgacagcatctgtaccggcaccagcagcggcaatcaagtgaacctgaccatccagggcctgagagctatggacaccggcctgtacatctgcaaggtggaactgatgtaccctcctccttactacctcggcatcggcaacggcacccaaatctacgtgatcgaccccgagccttgtcctgacagcgatttcggatccgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgtga

SEQ ID NO: 987 - DNA, 3219 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatggcctgtctgggcttccagagacacaaggcccagctcaacctggctaccagaacctggccttgtactctgctgttcttcctgctgttcatccccgtgttctgcaaggccatgcatgtggctcagcctgctgtggtgctggcctctagtagaggaatcgccagcttcgtgtgcgagtacgcctctcctggaaaggccactgaagtgcgcgtgaccgttctgagacaggccgatagccaagtgaccgaagtgtgcgccgccacctacatgatgggcaacgagctgaccttcctggacgacagcatctgtaccggcaccagcagcggcaatcaagtgaacctgaccatccagggcctgagagctatggacaccggcctgtacatctgcaaggtggaactgatgtaccctcctccttactacctcggcatcggcaacggcacccaaatctacgtgatcgaccccgagccttgtcctgacagcgatttcggatccgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 988 - DNA, 2700 bp, Artificial Sequence
  Synthetic Polynucleotide encoding a SIR
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 989 - DNA, 2697 bp, Artificial Sequence
  Synthetic Polynucleotide encoding a SIR
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcaacgcgtgagcagaaactgatctcggaagaggatgggagcggcatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 990 - DNA, 2853 bp, Artificial Sequence
  Synthetic Polynucleotide encoding a SIR
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 991 - DNA, 2706 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcccattccttcgaaggcagcggaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 992 - DNA, 2649 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggagcagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 993 - DNA, 2616 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggccctgcctgtgacagctctgctgctgcctctggcactgctgctgcacgccgccagacctgcactgcctagctgcaaagaggacgagtaccctgtcggcagcgagtgctgtcctaagtgtagccctggctacagagtgaaagaagcctgcggagagctgaccggcaccgtgtgtgaaccttgtcctcctggcacctatatcgcccacctgaacggcctgagcaagtgcctgcagtgccagatgtgcgatcctgctatgggcctgagagccagcagaaactgcagcagaaccgagaatgccgtgtgcggctgttctcccggccacttctgtattgtgcaggacggcgatcactgcgccgcctgtagagcctatgccacatctagccctggacagcgggttcagaaaggcggcacagagtctcaggataccctgtgccagaattgccctccaggcacattcagccccaacggcacactggaagagtgccagcaccagaccaagtgtagctggctggtcacaaaagccggcgctggcacaagcagctctcattgggtgtga

SEQ ID NO: 994 - DNA, 3006 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggccctgcctgtgacagctctgctgctgcctctggcactgctgctgcacgccgccagacctgcactgcctagctgcaaagaggacgagtaccctgtcggcagcgagtgctgtcctaagtgtagccctggctacagagtgaaagaagcctgcggagagctgaccggcaccgtgtgtgaaccttgtcctcctggcacctatatcgcccacctgaacggcctgagcaagtgcctgcagtgccagatgtgcgatcctgctatgggcctgagagccagcagaaactgcagcagaaccgagaatgccgtgtgcggctgttctcccggccacttctgtattgtgcaggacggcgatcactgcgccgcctgtagagcctatgccacatctagccctggacagcgggttcagaaaggcggcacagagtctcaggataccctgtgccagaattgccctccaggcacattcagccccaacggcacactggaagagtgccagcaccagaccaagtgtagctggctggtcacaaaagccggcgctggcacaagcagctctcattgggtgggcggaggcggaagtggaggcggaggatctggcggcggaggctctgaggtgcagctcgtggaatcaggcggaggtcttgtacagccaggaaattctcttcggctgtcttgcgccgcgagcgggttcaccttcagcagcttcggaatgagctgggtaagacaggcaccggggaaaggcctggagtgggtgagctcaatcagtgggagcgggtcagataccctgtacgcggattccgtgaagggcagattcacaatctctcgggacaatgctaagacaacactttaccttcagatgaactctctgcgacccgaggataccgctgtctactactgtacaataggaggttctctgtccagaagttctcaagggacactggtgaccgtctccagctga

SEQ ID NO: 995 - DNA, 2754 bp, Artificial Sequence
  Synthetic Polynucleotide encoding a SIR
atggccttaccagtgaccgccttgctcctgccgctggccttgctgctccacgccgccaggccggacatccagatgacacagactacatcctcactgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 996 - skipped

SEQ ID NO: 997 - DNA, 1386 bp, Artificial Sequence
  Synthetic Polynucleotide encoding a SIR
atggactggatttggcgcatccttttccttgtcggcgctgctaccggcgcgcattccttcgaagaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 998 - DNA, 3282 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatgaagtggaaggccctgttcaccgccgccattctccaggcccaactgcctatcacagaggcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaggcggcggatccaagagaggccggaagaagctgctgtacatcttcaagcagcctttcatgcggcccgtgcagaccacccaggaagaggacggctgctcctgccggttccccgaggaagaagaaggcggctgcgagctgcatatgcgggccaagagatccggtagcggagagggaagaggtagcctcctcacctgtggggacgttgaagagaaccccggcccaggtaccatgggcaacgaggccagctaccctctggagatgtgctcccacttcgacgccgacgagatcaagcggctgggcaagcgcttcaagaagctggacctggacaacagcggcagcctgagcgtggaggagtttatgtctctgcccgagctgcagcagaaccccctggtgcagcgcgtgatcgacatcttcgacaccgacggcaacggcgaggtggacttcaaggagttcatcgagggcgtgagccagttcagcgtgaagggcgacaaggagcagaagctgcggttcgccttccgcatctacgatatggataaagatggctatatttctaatggcgagctgttccaggtgctgaagatgatggtgggcaacaataccaagctggccgatacccagctgcagcagatcgtggacaagaccatcatcaacgccgacaaggacggcgacggcagaatcagcttcgaggagttctgtgccgtggtgggaggcctggatattcacaaaaaaatggtggtggacgtgtga

SEQ ID NO: 999 - DNA, 2655 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgggagcggctggtctcatccccagtttgaaaagggcagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1000 - DNA, 2859 bp, Artificial Sequence
  Synthetic Polynucleotide encoding a SIR
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1001-1014 - skipped (14 entries)

SEQ ID NO: 1015 - DNA, 2730 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcccattccttcgaaggcagcggaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1016 - DNA, 2709 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcccattccttcgaaggcagcggaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1017 - DNA, 2655 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcccattccttcgaaggcagcggaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1018 - DNA, 2916 bp, Artificial Sequence
  Synthetic polynucleotide encoding a SIR
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcaccatggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1019 - DNA, 2709 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcccattccttcgaaggcagcggaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1020 - DNA, 2709 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcccattccttcgaaggcagcggaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1021 - DNA, 2646 bp, Artificial Sequence
  Synthetic polynucleotide encoding a SIR
atggccctgcctgtgacagctctgctgctgcctctggcactgctgctgcacgccgccagacctgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctgggcgcgccatggactggatttggcgcatccttttccttgtcggcgctgctaccggcgcgcattccttcgaacaggtgcagctccaggaatctggccctggcctcgtgaagcctagtcagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggcccccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1022 - DNA, 2079 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1023 - DNA, 2079 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1024 - DNA, 1956 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1025 - DNA, 2166 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1026 - DNA, 3426 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1027 - DNA, 3456 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtgccaccatggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1028 - DNA, 3435 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1029 - DNA, 3417 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1030 - DNA, 3426 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcaccatggccttaccagtgaccgccttgctcctgccgctggccttgctgctccacgccgccaggccggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1031 - DNA, 3447 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1032 - DNA, 3045 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggactggatttggcgcatccttttccttgtcggcgctgctaccggcgcgcattccttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1033 - DNA, 3432 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1034 - DNA, 3423 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1035 - DNA, 3429 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcaccatggccttaccagtgaccgccttgctcctgccgctggccttgctgctccacgccgccaggccggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagggcggaggcggaagtggaggcggaggatctggcggcggaggctctgaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1036 - DNA, 3444 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcaccatggccttaccagtgaccgccttgctcctgccgctggccttgctgctccacgccgccaggccggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1037 - DNA, 3666 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtgccaccatggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1038 - DNA, 2652 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1039 - DNA, 2652 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1040 - DNA, 2652 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1041 - DNA, 2616 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1042 - DNA, 2652 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1043 - DNA, 2640 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1044 - DNA, 2571 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1045 - DNA, 2571 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1046 - DNA, 2571 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1047 - DNA, 2571 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1048 - DNA, 2655 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1049 - DNA, 2643 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggaacagaaattgataagtgaggaagacttgggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1050 - DNA, 2643 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgagggaggctggtcccatccccagttcgagaaaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1051 - DNA, 2547 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggacctgaagaacgtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgagagctaccagcagggcgtgctgtctgccaccatcctgtacgagatcctgctgggcaaggccaccctgtacgccgtgctggtgtccgccctggtgctgatggctatggtgaagcggaaggacttcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtcctgatcctgccgtgtaccagctgcgggatagcaagagcagcgacaagagcgtgtgcctgttcaccgacttcgacagccagaccaacgtgtctcagtctaaggatagtgatgtgtatatcaccgacaagaccgtgctggacatgcggagcatggacttcaagagcaacagcgccgtggcctggtccaacaagagcgacttcgcctgcgccaacgccttcaacaacagcatcatccccgaggacaccttcttccccagccccgagagcagctgcgacgtgaaactggtggagaagagcttcgagacagacaccaacctgaacttccagaacctgagcgtgatcggcttcagaatcctgctgctgaaggtggccggcttcaacctgctgatgaccctgcggctgtggagcagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1052 - DNA, 2547 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggacctgaacaaggtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgtgagctaccagcagggcgtgctgtctgccaccatcctgtacgagatcctgctgggcaaggccaccctgtacgccgtgctggtgtccgccctggtgctgatggctatggtgaagcggaaggacttcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtcctgatcctgccgtgtaccagctgcgggatagcaagagcagcgacaagagcgtgtgcctgttcaccgacttcgacagccagaccaacgtgtctcagtctaaggatagtgatgtgtatatcaccgacaagaccgtgctggacatgcggagcatggacttcaagagcaacagcgccgtggcctggtccaacaagagcgacttcgcctgcgccaacgccttcaacaacagcatcatccccgaggacaccttcttccccagccccgagagcagctgcgacgtgaaactggtggagaagagcttcgagacagacaccaacctgaacttccagaacctgagcgtgatcggcttcagaatcctgctgctgaaggtggccggcttcaacctgctgatgaccctgcggctgtggagcagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1053 - DNA, 3006 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtgtggggcgagggcagctacctgagcagctaccctacatgccctgcccaggcttggtgcagcagaagcgcactgagagcacccagctctagcctgggagccttctttgccggcgatctgcctccaccactccaggctggcgctgctcgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1054 - DNA, 2862 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1055 - DNA, 2598 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1056 - DNA, 2562 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1057 - DNA, 2598 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1058 - DNA, 2952 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtgtggggcgagggcagctacctgagcagctaccctacatgccctgcccaggcttggtgcagcagaagcgcactgagagcacccagctctagcctgggagccttctttgccggcgatctgcctccaccactccaggctggcgctgctcgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1059 - DNA, 2808 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1060 - DNA, 2673 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1061 - DNA, 2691 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1062 - DNA, 2652 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1063 - DNA, 2634 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1064 - DNA, 2622 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggatctgcggaacgtgaccccacccaaggtgtccctgttcgagcccagcaaggccgagatcgccaataaacagaaggccaccctcgtgtgcctggccagaggcttcttccccgaccacgtggaactgtcttggtgggtcaacggcaaagaggtgcacagcggcgtcagcaccgaccctcaggcctacaaagagagcaactacagctactgcctgagcagtcggctgcgggtgtccgccaccttctggcacaacccccggaaccacttcagatgccaggtgcagttccacggcctgagcgaagaggacaagtggcccgagggcagccccaagcctgtcacccagaacatcagcgccgaggcctggggcagagcctgtggcatcaccagcagctaccagcagggcgtgctgagcgccaccatcctgtacgagatcctgctgggcaaggccaccctgtacgccgtgctggtgtccaccctggtggtcatggctatggtcaagcggaagaacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgaacctgccgtgtaccagctgaaggaccccagaagccaggacagcaccctgtgcctgttcaccgacttcgacagccagatcaacgtgcccaagacaatggaaagcggcaccttcatcaccgacaagaccgtgctggacatgaaggctatggacagcaagagcaacggcgccattgcctggtccaaccagaccagcttcacatgccaggacatcttcaaagagacaaacgccacctacccctccagcgacgtgccctgtgacgccaccctgaccgagaagtccttcgagacagacatgaacctcaacttccagaacctgagcgtgatgggcctgcgaatcctgctgctgaaagtggccggcttcaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1065 - DNA, 2535 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggacctccagaaagtgaccccccctaccgtgaccgtgttcgagccttctgaggccgagatcagccggacccagaaagccacactcgtgtgcctggctcggggcttctaccccgatcacgtggaactgtcttggtgggtcaacggcaaagaagtgaccagcggcttcagcaccgacccccagcctgacaaagagcggcccagcgagaacgacagcagctactgcctgagcagcagactgagagtgtccgccagcttctggcacaacccccggaaccacttcagatgccaggtgcagttctacggcctgggcgacgacgacgagtggaagtacgacagagtgaagcccatcacccagaacatcagcgccgaagcctggggcagagccgattgcggctttacctccgtcagctaccaccagggcgtgctgagcgccaccatcctgtacgagatcctgctgggcaaggccaccctgtacgccgtgctggtgtctatcctggtgctgatggctaaagtgaagcggaagggcagcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgtgcaggaccctgaccctagcgtgtaccagatgagaagccccaagaccggcaggaccgtgtgcctgttcaccgacttcgacagccaggccgacttccagaagcctgagggggccaccgtgatctccctgaacagcaccgtgctggacatgaaagtgatggacagcaagagcaacggcgctctgacctggaacagcgagacaaacatcgagtgcaaagagaacttccagcagcccttctaccccagcagcaactactcctgcgacgccaagctgatcgagaagtccttcgagacagacatggacctgaacttctacaacctgctggtcatcggcctgagaatcctgctgctgaaagtgatcggcttcaacctgttcatgaccctgaggctgtggtcctgccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1066 - DNA, 2643 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggtctggaggcggaggcagcggcggaggcgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtggcagcggcggaggcggaagtggaggcggaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1067 - DNA, 2673 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccagtcgagaccgatttctacgactacaaggacgacgatgacaagcatatgtga

SEQ ID NO: 1068 - DNA, 2817 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaacatatgtga

SEQ ID NO: 1069 - DNA, 2667 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatgaagtggaaggccctgttcaccgccgccattctccaggcccaactgcctatcacagaggcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagatga

SEQ ID NO: 1070 - DNA, 2679 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatgaagtggaaggccctgttcaccgccgccattctccaggcccaactgcctatcacagaggcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaggcggcggatccaagagaggccggaagaagctgctgtacatcttcaagcagcctttcatgcggcccgtgcagaccacccaggaagaggacggctgctcctgccggttccccgaggaagaagaaggcggctgcgagctgtga

SEQ ID NO: 1071 - DNA, 2541 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatgaagtggaaggccctgttcaccgccgccattctccaggcccaactgcctatcacagaggcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagatga

SEQ ID NO: 1072 - DNA, 2844 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgatcgagacatacaaccagaccagccccagaagcgccgccaccggactgcccatcagcatgaagattttcatgtacctgctgaccgtgttcctgattacccagatgatcggcagcgccctgttcgccgtgtacctgcacagacggctggacaagatcgaggacgagcggaacctgcacgaggacttcgtgtttatgaagaccatccagcggtgcaacaccggcgagagaagcctgagcctgctgaactgcgaggaaatcaagagccagttcgagggcttcgtgaaggacatcatgctgaacaaagaggaaactaagaaagaaaacagcttcgagatgcagaagggcgaccagaacccccagattgccgcccacgtgatctctgaggccagcagcaagaccacctccgtgctccagtgggccgagaagggctactacaccatgagcaacaacctcgtgaccctggaaaacggcaagcaactgaccgtgaagcggcagggcctgtactacatctacgcccaagtgaccttctgctccaacagagaggccagctcccaggccccctttatcgccagcctgtgcctgaagtcccccggcagattcgagagaatcctgctgagagccgccaacacccacagcagcgccaagccttgtggacagcagagcatccacctgggcggcgtgttcgagcttcagcctggcgcttccgtgttcgtgaacgtgaccgaccctagccaggtgtcccacggcaccggctttaccagcttcggactgctgaagctgtga

SEQ ID NO: 1073 - DNA, 3549 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacagtcgagaccgatttctacgactacaaggacgacgatgacaagcatatgtga

SEQ ID NO: 1074 - DNA, 2691 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatgtcgagaccgatttctacgactacaaggacgacgatgacaagtga

SEQ ID NO: 1075 - DNA, 3006 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccagtcgagaccgatttctacgactacaaggacgacgatgacaagtga

SEQ ID NO: 1076 - DNA, 3327 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccagtcgagaccgatttctacgactacaaggacgacgatgacaagtga

SEQ ID NO: 1077 - DNA, 3120 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggcccatttcccagggtttggacagagtcttcttttcggatacccagtctacgtgtttggagactgtgtacaaggcgactggtgccccatctctgggggactatgttcggcccgcctacatcgtcacgccctactggccacctgtccagagcatcagatcacctgggaccccatcgacggacgcgttatcggctcagctctacagttccttatccctcgactcccctccttccccacccagagaacctctaagaccctcaaggtccttaccccgccaatcactcatacaacccccaacattccaccctccttcctccaggccatgcgcaaatactcccccttccgaaatggatacatggaacccacccttgggcagcacctcccaaccctgtcttttccagaccccggactccggccccaaaacctgtacaccctctggggaggctccgttgtctgcatgtacctctaccagctttccccccccatcacctggcccctcctgccccacgtgattttttgccaccccggccagctcggggccttcctcaccaatgttccctacaagcgaatagaagaactcctctataaaatttccctcaccacaggggccctaataattctacccgaagactgtttgcccaccacccttttccagcctgctagggcacccgtcacgctaacagcctggcaaaacggcctccttccgttccactcaaccctcaccactccaggccttatttggacatttaccgatggcacgcctatgatttccgggccctgccctaaagatggccagccatctttagtactacagtcctcctcctttatatttcacaaatttcaaaccaaggcctaccacccctcatttctactctcacacggcctcatacagtactcttcctttcatagtttacatctcctgtttgaagaatacaccaacatccccatttctctactttttaacgaaaaagaggcagatgacaatgaccatgagccccaaatatcccccgggggcttagagcctcccagtgaaaaacatttccgagaaacagaagtctga

SEQ ID NO: 1078 - DNA, 3129 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggcgcactttccgggctttggacagtcactcctgtacggctatcccgtctatgtattcggtgattgtgtgcaagccgattggtgtccagtgtccggtggtctgtgcagtacacggcttcaccggcacgccctgctggcaacttgccccgaacaccagcttacatgggacccaatcgacggtcgcgtagtgtcttctcccctccagtatctgattcctagattgccttcctttccaacacagaggaccagccggaccctgaaggttctgaccccaccgactacaccagtgtcccccaaagtgcctcccgccttcttccaaagtatgagaaaacatactccctataggaatggctgcttggagccaaccctcggtgaccaactcccctcactcgccttccccgaacctggcctgcgcccacagaacatctatactacttggggcaagactgtggtatgcctttacctgtaccagctgagtcccccgatgacatggcccctcatcccccacgtcattttctgtcacccacggcagctgggagcgttccttaccaaagttccgctcaaacgcctggaggaactgctgtataagatgtttctgcacactggtgccgtgatcgtgctgcccgaggacgatctgcccaccacaatgttccagccggtgcgggctccttgcatccagactgcttggtgcacaggccttctgccttaccactccatactcacaacccctggtctgatctggaccttcaatgacggaagccctatgatttcaggaccttgtcccaaggctggacagccatctctggttgtgcagtcatctctgctcatcttcgagaaattccaaaccaaggcctttcatccatcctacctcctctcccatcagctgatacagtacagctccttccacaacttgcacctgctctttgatgaatatacgaatattccagtcagcatactcttcaacaagggcgaggccgatgataatggcgaccagccgcctgagcctgccgcacagggtgaaagctccacacagaaggtgcggccctcccatactaacaatccaaagtga

SEQ ID NO: 1079 - DNA, 3129 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggcgcactttccgggctttggacagtcactcctgtacggctatcccgtctatgtattcggtgattgtgtgcaagccgattggtgtccagtgtccggtggtctgtgcagtacacggcttcaccggcacgccctgctggcaacttgccccgaacaccagcttacatgggacccaatcgacggtcgcgtagtgtcttctcccctccagtatctgattcctagattgccttcctttccaacacagaggaccagccggaccctgaaggttctgaccccaccgactacaccagtgtcccccaaagtgcctcccgccttcttccaaagtatgagaaaacatactccctataggaatggctgcttggagccaaccctcggtgaccaactcccctcactcgccttccccgaacctggcctgcgcccacagaacatctatactacttggggcaagactgtggtatgcctttacctgtaccagctgagtcccccgatgacatggcccctcatcccccacgtcattttctgtcacccacggcagctgggagcgttccttaccaaagttccgctcaaacgcctggaggaactgctgtataagatgtttctgcacactggtgccgtgatcgtgctgcccgaggacgatctgcccaccacaatgttccagccggtgcgggctccttgcatccagactgcttggtgcacaggccttctgccttaccactccatactcacaacccctggtctgatctggaccttcaatgacggaagccctatgatttcaggaccttgtcccaaggctggacagccatctctggttgtgcagtcatctctgctcatcttcgagaaattccaaaccaaggcctttcatccatcctacctcctctcccatcagctgatacagtacagctccttccacaacttgcacctgctctttgatgaatatacgaatattccagtcagcagaagcttcaacaagggcgaggccgatgataatggcgaccagccgcctgagcctgccgcacagggtgaaagctccacacagaaggtgcggccctcccatactaacaatccaaagtga

SEQ ID NO: 1080 - DNA, 3261 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgctggaaggcgtgcaggtggaaaccatcagccctggcgacggcagaaccttccctaagaggggccagacctgcgtggtgcactacaccggaatgctggaagatggcaagaaggtggacagcagccgggaccggaacaagcccttcaagttcatgctgggcaagcaggaagtgatccggggctgggaagagggcgtggcccagatgtctgtgggccagagagccaagctgaccatctcccccgattacgcctacggcgctacaggccaccctggcatcattcctccacacgccacactggtgttcgacgtggaactgctgaagctggaaagcggcggaggcagcggagtggatggcttcggagatgtgggagccctggaaagcctgagaggcaacgccgacctggcctacatcctgagcatggaaccttgcggccactgcctgattatcaacaacgtgaacttctgccgcgagagcggcctgagaaccagaaccggcagcaacatcgactgcgagaagctgcggcggagattcagcagcctgcacttcatggtggaagtgaagggcgacctgaccgccaagaaaatggtgctggccctgctggaactggcccagcaggatcatggcgctctggactgctgtgtggtcgtgatcctgagccacggctgccaggcttcccatcttcagttccctggcgctgtgtacggcaccgatggctgtcctgtgtccgtggaaaagatcgtgaacatcttcaacggcaccagctgccccagcctgggcggaaagcccaagctgttctttattcaagcctgtggcggcgagcagaaggaccacggctttgaggtggcctccaccagccctgaggatgagagccctggcagcaaccctgagcctgacgccaccccattccaggaaggactgcggaccttcgaccagctggacgccatctctagcctgcccacccccagcgacatcttcgtgtcctacagcaccttccccggctttgtgtcctggcgggaccctaagagcggctcttggtacgtggaaaccctggacgacatctttgagcagtgggctcacagcgaggacctccagagcctgctgctgagagtggctaacgccgtgtccgtgaagggcatctacaagcagatgcctggctgcttcaacttcctgcggaagaagctgtttttcaagaccagctga

SEQ ID NO: 1081 - DNA, 2871 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggattggatatggaggatactttttctcgtgggggcagcaaccggggctcattccgaggttcagttggtcgaatcaggcgggggcctcgtccaacccggcggaagcctgcggctgtcttgcgcagcaagtggtagtgtgttcaagatcaacgttatggcctggtatcgccaggctccgggaaaagggagagagctggttgcggggatcattagcggtggctccaccagctacgctgacagtgtgaagggaaggttcactatatcacgcgacaacgcaaagaatacattgtacctccagatgaatagcttgcggcccgaagacacggcagtctactattgtgcctttatcacaacagagagcgactatgacctgggccgccggtattgggggcagggaacccttgtgaccgtttcatccggcggaggcggaagtggaggcggaggatctggcggcggaggctctgaggtgcagctcgtggaatcaggcggaggtcttgtacagccaggaaattctcttcggctgtcttgcgccgcgagcgggttcaccttcagcagcttcggaatgagctgggtaagacaggcaccggggaaaggcctggagtgggtgagctcaatcagtgggagcgggtcagataccctgtacgcggattccgtgaagggcagattcacaatctctcgggacaatgctaagacaacactttaccttcagatgaactctctgcgacccgaggataccgctgtctactactgtacaataggaggttctctgtccagaagttctcaagggacactggtgaccgtctccagctga

SEQ ID NO: 1082 - DNA, 3681 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgtgccatcagcagctcgtgattagctggttcagcctggtgttcctggcctcccccctggtggctatctgggagctgaagaaagacgtgtacgtggtggaactggactggtatcccgacgcccctggcgagatggtggtgctgacctgcgatacccccgaagaggacggcatcacctggaccctggatcagagcagcgaggtgctgggcagcggcaagaccctgaccatccaagtgaaagagttcggcgacgccggccagtacacctgtcacaagggcggagaggtgctgagccacagcttgctgctgctgcacaagaaagaggatggcatttggagcaccgacatcctgaaggaccagaaagagcccaagaacaagaccttcctgagatgcgaggccaagaactacagcggcagattcacctgttggtggctgaccaccatcagcaccgacctgaccttcagcgtgaagtccagcagaggcagcagcgaccctcagggcgtgacatgtggcgctgctacactgagcgccgagagagtgcggggcgacaacaaagaatacgagtacagcgtggaatgccaggaagatagcgcctgccctgccgccgaggaaagcctgcctatcgaagtgatggtggacgccgtgcacaagctgaagtacgagaactacaccagcagctttttcatccgggacatcatcaagcccgacccccccaagaacctccagctgaagcccctgaagaacagcagacaggtggaagtgtcctgggagtaccccgacacctggtccaccccccacagctacttcagcctgacattctgtgtgcaagtgcagggcaagtccaagcgcgagaaaaaggaccgggtgttcaccgacaagaccagcgccaccgtgatctgccggaagaacgccagcatcagcgtgcgcgcccaggatcggtactacagcagctcttggagcgagtgggccagcgtgccatgttctggcggcggaggatctgggggaggcggaagcggagggggaggatctaggaatctgcccgtggctacccccgaccccggcatgtttccttgtctgcaccacagccagaacctgctgcgggccgtgtccaacatgctccagaaggccagacagaccctggagttctacccctgcaccagcgaggaaatcgaccacgaggacatcaccaaggataagaccagcaccgtggaagcctgtctgcccctggaactgaccaagaacgagagctgcctgaacagccgggaaaccagcttcatcaccaacggctcttgcctggcttccagaaagacctccttcatgatggccctgtgcctgagcagcatctacgaggacctgaagatgtaccaggtggagttcaagaccatgaacgccaaactgctgatggaccccaagaggcagattttcctggaccagaatatgctggccgtgatcgacgagctgatgcaggccctgaacttcaacagcgagacagtgccccagaagtcctccctggaagaacccgacttctacaagaccaagatcaagctgtgcatcctgctgcacgccttcagaatccgggccgtgaccatcgacagagtgatgagctacctgaacgcctcctga

SEQ ID NO: 1083 - DNA, 2826 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgtccgactccaaggaggtccctagccttccatttttgcgacacttgctcgaagagttggacagccatgaggacagcttgctgctgtttctgtgtcacgacgcggccccgggctgcacgacggtcacgcaagctttgtgctcgcttagccaacagcgcaagctgaccctcgcggctctggtcgagatgctctacgtgctgcagcgtatggatcttctcaagagccgcttcgggctcagcaaggagggggccgagcaattgctgggcacaagctttctcacgcgctaccgcaagctcatggtttgcgtgggtgaggagctcgactcgagcgagctacgcgctctacgcttgttcgcgtgcaacctgaatccgagcctgagcacggcgctttctgagagcagccgctttgtcgagcttgtactcgcgcttgaaaacgtaggactcgtctcgccatcgagtgtttccgtgcttgcggacatgttgcgcactcttcggcgcctcgatttgtgccagcagcttgttgagtacgaacaacaagagcaagccaggtaccgttactgttacgcggcctcgccctcattgccagttcgtacgttacgtcgggggcacggcgcgagtgaacacgagcagctgtgcatgcccgtgcaagaatcctctgacagccccgagctgctgcgcacgcccgtacaagaatcctccagcgacagccccgagcaaacgactgtcgagaccgatttctacgactacaaggacgacgatgacaagtga

SEQ ID NO: 1084 - DNA, 2799 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggccctgcctgtgacagctctgctgctgcctctggcactgctgctgcacgccgccagacctgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcgaggacttcgccgtgtactactgccagcagagcaccttcggccagggcaccaaggtggaaatcaagggcggaggcggatctggcggcggaggatctgggggaggcggctctcaggtgtacctggtggaaagcggagggggcgtggtgcagcctggaagaagcctgagactgagctgtgccgccagcggcttcaccttcagcaactacggaatgcactgggtgcgccaggcccctggcaaaggactggaatgggtggccctgatttggtacgacggcagcaacaagtattacgccgacagcgtgaagggccggttcaccatcagccgggacaacagcaagaacaccctgtacctccagatgaccagcctgcgggtggaagataccgccgtgtattattgcgccagcaacgtggaccactggggccagggaacactcgtgaccgtgtctagctga

SEQ ID NO: 1085 - DNA, 2820 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggccctgcctgtgacagctctgctgctgcctctggcactgctgctgcacgccgccagacctgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacctttggacagggcaccaaggtggaaatcaagggcggaggcggatctggcggcggaggatctgggggaggcggctctcaggtgcagctggtggaaagtgggggaggatggcagcctggcagaagcctgagactggactgcaaggccagcggcatcaccttcagcaacagcggaatgcactgggtgcgccaggcccctggaaagggactggaatgggtggccgtgatctatgacggcagcaagcggtactacgccgacagcgtgaagggccggttcatcagccgggacaacagcaagaataccctgttcctccagatgaacagcctgcgggccgaggacacagccgtgtattattgcgccaccaacgacgactactggggccagggaacactcgtgaccgtgtcctcttga

SEQ ID NO: 1086 - DNA, 3333 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgcgaccctccgggacggccggggcagcgttcctggcgctgctggctgcgctctgcccggcgagtcgggctctggaggaaaagaaaggtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagccttga

SEQ ID NO: 1087 - DNA, 3132 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgctgctgctcgtgaccagcctgctgctgtgcgaactgccccaccctgcctttctgctgatcccccggaaagtgtgcaacggcatcggcatcggagagttcaaggacagcctgagcatcaacgccaccaacatcaagcacttcaagaactgcaccagcatcagcggcgacctgcacatcctgcccgtggcctttagaggcgacagcttcacccacacccccccactggaccctcaggaactggacatcctgaaaaccgtgaaagagatcaccggatttctgctgattcaggcttggcccgagaaccggaccgatctgcacgccttcgagaacctggaaatcatccggggcaggaccaagcagcacggccagttttctctggccgtggtgtccctgaacatcaccagcctgggcctgcggagcctgaaagaaatcagcgacggggatgtgattatcagcggcaacaagaacctgtgctacgccaacaccatcaactggaagaagctgttcggcacctccggccagaaaacaaagatcatcagcaaccggggcgagaacagctgcaaggccacaggacaagtgtgccacgccctgtgtagccctgagggctgttggggacccgagcccagagattgcgtgtcctgccggaatgtgtccagaggccgcgagtgcgtggacaagtgcaacctgctggaaggcgagccccgcgagtttgtggaaaacagcgagtgcatccagtgccaccccgagtgtctgccccaggccatgaatatcacctgtaccggcagaggccccgacaactgtatccagtgcgcccactacatcgacggcccccactgcgtgaaaacctgtccagctggcgtgatgggagagaacaacaccctcgtgtggaagtacgccgacgccggccatgtgtgccacctgtgtcaccccaactgcacctacggctgtacaggccctggcctggaaggctgccctaccaacggacccaagatccccagcattgccaccggcatggtgggagcattgctgctgctgctggtggtggccctgggcatcggcctgtttatgtga

SEQ ID NO: 1088 - DNA, 2307 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgattctctggacctgtttgggactgagcttaataatttctttggcagttttcgtgctaatgtttttgctaaggaagataaactcttga

SEQ ID NO: 1089 - DNA, 3189 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacatggccctgcctgtgacagctctgctgctgcctctggcactgctgctgcacgccgccagacctgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcgaggacttcgccgtgtactactgccagcagagcaccttcggccagggcaccaaggtggaaatcaagggcggaggcggatctggcggcggaggatctgggggaggcggctctcaggtgtacctggtggaaagcggagggggcgtggtgcagcctggaagaagcctgagactgagctgtgccgccagcggcttcaccttcagcaactacggaatgcactgggtgcgccaggcccctggcaaaggactggaatgggtggccctgatttggtacgacggcagcaacaagtattacgccgacagcgtgaagggccggttcaccatcagccgggacaacagcaagaacaccctgtacctccagatgaccagcctgcgggtggaagataccgccgtgtattattgcgccagcaacgtggaccactggggccagggaacactcgtgaccgtgtctagcggcggaggcggaagtggaggcggaggatctggcggcggaggctctgaggtgcagctcgtggaatcaggcggaggtcttgtacagccaggaaattctcttcggctgtcttgcgccgcgagcgggttcaccttcagcagcttcggaatgagctgggtaagacaggcaccggggaaaggcctggagtgggtgagctcaatcagtgggagcgggtcagataccctgtacgcggattccgtgaagggcagattcacaatctctcgggacaatgctaagacaacactttaccttcagatgaactctctgcgacccgaggataccgctgtctactactgtacaataggaggttctctgtccagaagttctcaagggacactggtgaccgtctccagctga

SEQ ID NO: 1090 - DNA, 3366 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggcgggatccacatggccctgcctgtgacagctctgctgctgcctctggcactgctgctgcacgccgccagacctgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacctttggacagggcaccaaggtggaaatcaagggcggaggcggatctggcggcggaggatctgggggaggcggctctcaggtgcagctggtggaaagtgggggaggatggcagcctggcagaagcctgagactggactgcaaggccagcggcatcaccttcagcaacagcggaatgcactgggtgcgccaggcccctggaaagggactggaatgggtggccgtgatctatgacggcagcaagcggtactacgccgacagcgtgaagggccggttcatcagccgggacaacagcaagaataccctgttcctccagatgaacagcctgcgggccgaggacacagccgtgtattattgcgccaccaacgacgactactggggccagggaacactcgtgaccgtgtcctctggcggaggcggaagtggaggcggaggatctggcggcggaggctctgaggtgcagctcgtggaatcaggcggaggtcttgtacagccaggaaattctcttcggctgtcttgcgccgcgagcgggttcaccttcagcagcttcggaatgagctgggtaagacaggcaccggggaaaggcctggagtgggtgagctcaatcagtgggagcgggtcagataccctgtacgcggattccgtgaagggcagattcacaatctctcgggacaatgctaagacaacactttaccttcagatgaactctctgcgacccgaggataccgctgtctactactgtacaataggaggttctctgtccagaagttctcaagggacactggtgaccgtctccagctga

SEQ ID NO: 1091 - DNA, 3438 bp, Artificial Sequence
  Synthetic polynucleotide encoding a SIR
atggccttaccagtgaccgccttgctcctgccgctggccttgctgctccacgccgccaggccggagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatgggcagcagcaagagcaagcctaaggaccccagccagagactgaatgctgctggtggacctggcgctggatctgctgctcctgtgtctagcacaagcagcctgcctctggccgctctgaacatgagagtcagaagaaggctgagcctgttcctgaacgtgcggacacaggtggccgctgattggacagctctggccgaggaaatggacttcgagtacctggaaatccggcagctggaaacccaggccgatcctacaggcagactgctggatgcttggcaaggcagaccaggcgcttctgtggggagactgcttgacctgctgacaaagctgggcagagatgacgtgctgctggaactgggacccagcatcgaggaagattgccagaagtacatcctgaagcagcaacaagaagaggccgagaagcctctgcaggttgccgccgtggatagcagcgttccaagaacagctgagctggccggcatcaccacactggatgatcctctgggacacatgcccgagagattcgacgccttcatctgctactgccccagcgacatcgtgggcaagaagcccacaaacaaggcccctcatcctaagcaagagccccaagagatcaacttccccgacgatctgcccggcagcaatactgctgcacccgtgcaagaaaccctgcacggttgtcagcccgtgacacaagaggacggcaaagaaagccggatctccgtccaagagcggcaagttggcggagtgcaggtcgagacaatctctcctggcgacggcagaacattccccaagaggggacagacctgctggcactacaccggaatgctggaagatggcaagaaggtggacagcagccgggacagaaacaagcccttcaagttcatgctgggcaagcaagaagtgattcgcggctgggaagagggcgtcgcacagatgtctgttggacagagagccaagctgacaatcagccccgactacgcctatggcgctacaggacaccctggcatcattcctccacacgccacactggtgttcgacgtggaactgctgaagctggaagtcggaggcgtccaggtggaaaccatcagtccaggcgacggacggacctttcctaagagaggccagacttgttggcattatacagggatgcttgaggacgggaagaaagtggactcctccagagatcggaacaagccgtttaagtttatgctcggaaaacaagaagtcataagaggctgggaagagggtgttgcccaaatgagcgtgggccagcgcgccaaactgaccatctctccagattatgcctacggcgcaaccggccatccaggcattattccacctcatgctaccctggtgtttgatgtcgagctgctcaaactggaatga

SEQ ID NO: 1092 - DNA, 3246 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1093 - DNA, 3294 bp, Artificial Sequence
  Synthetic polynucleotide encoding a SIR
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagcaccatggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1094 - DNA, 3300 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcccattccttcgaaggcagcggaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1095 - DNA, 2925 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcccattccttcgaaggcagcggaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1096 - DNA, 2925 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcccattccttcgaaggcagcggaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1097 - DNA, 3654 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1098 - DNA, 2556 bp, Artificial Sequence
  Synthetic polynucleotide encoding a SIR
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgagagttggaaggatgcctctggatggtcttgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaacgcgtgagcagaaactgatctcggaagaggatctgagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1099 - DNA, 2703 bp, Artificial Sequence
  Synthetic polynucleotide encoding a SIR
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcaccatggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1100-1109 - skipped (10 entries)

SEQ ID NO: 1110 - DNA, 2676 bp, Artificial Sequence
  Polynucleotide encoding a Synthetic Immune Receptor (SIR)
atggccttaccagtgaccgccttgctcctgccgctggccttgctgctccacgccgccaggccggacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctgggcgcgccatggactggatttggcgcatccttttccttgtcggcgctgctaccggcgcgcattccttcgaacaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtcgcgtagagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggcccccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1111 - DNA, 2196 bp, Artificial Sequence
  Polynucleotide encoding a Synthetic Immune Receptor (SIR)
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1112 - DNA, 2643 bp, Artificial Sequence
  Polynucleotide encoding a Synthetic Immune Receptor (SIR)
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctgggcgcgccatggactggatttggcgcatccttttccttgtcggcgctgctaccggcgcgcattccttcgaagacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggcccccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1113 - DNA, 2544 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaactcgaggacctccagaaagtgaccccccctaccgtgaccgtgttcgagccttctgaggccgagatcagccggacccagaaagccacactcgtgtgcctggctcggggcttctaccccgatcacgtggaactgtcttggtgggtcaacggcaaagaagtgaccagcggcttcagcaccgacccccagcctgacaaagagcggcccagcgagaacgacagcagctactgcctgagcagcagactgagagtgtccgccagcttctggcacaacccccggaaccacttcagatgccaggtgcagttctacggcctgggcgacgacgacgagtggaagtacgacagagtgaagcccatcacccagaacatcagcgccgaagcctggggcagagccgattgcggctttacctccgtcagctaccaccagggcgtgctgagcgccaccatcctgtacgagatcctgctgggcaaggccaccctgtacgccgtgctggtgtctatcctggtgctgatggctaaagtgaagcggaagggcagcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtgtgcaggaccctgaccctagcgtgtaccagatgagaagccccaagaccggcaggaccgtgtgcctgttcaccgacttcgacagccaggccgacttccagaagcctgagggggccaccgtgatctccctgaacagcaccgtgctggacatgaaagtgatggacagcaagagcaacggcgctctgacctggaacagcgagacaaacatcgagtgcaaagagaacttccagcagcccttctaccccagcagcaactactcctgcgacgccaagctgatcgagaagtccttcgagacagacatggacctgaacttctacaacctgctggtcatcggcctgagaatcctgctgctgaaagtgatcggcttcaacctgttcatgaccctgaggctgtggtcctgccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1114 - DNA, 3669 bp, Artificial Sequence
  Polynucleotide encoding a Synthetic Immune Receptor (SIR)
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggagtgggtcaagttcgccaagccttgcagagaaggcgaggacaacagcaagcggaaccctatcgccaagatcaccagcgactaccaggccacacagaagatcacctaccggatctctggcgtgggcatcgaccagcctccattcggcatcttcgtggtggacaagaacaccggcgacatcaacatcaccgccatcgtggacagagaggaaacccctagcttcctgattacctgtagagccctgaacgcccagggcctcgatgtggaaaagcctctgatcctgaccgtgaagatcctggacatcaacgacaaccctccagtgttcagccagcagattttcatgggcgagatcgaggaaaacagcgccagcaacagcctggtcatgatcctgaatgccaccgacgccgacgagcccaaccacctgaatagcaagatcgccttcaagatcgtgtcccaagagcctgccggcacacccatgtttctgctgtccagaaataccggcgaagtgcggaccctgaccaatagcctggatagagagcaggccagcagctacagactggtggtgtctggcgctgacaaggatggcgagggactgagcacccagtgcgagtgcaacatcaaagtgaaggacgtgaacgacaacttccccatgttccgggacagccagtatagcgcccggatcgaagagaacatcctgagcagcgagctgctgcggttccaagtgaccgacctggacgaagagtacaccgacaactggctggccgtgtacttcttcaccagcggcaacgaaggcaactggttcgagatccagacagaccccaggaccaacgagggcatcctgaaggttgtgaaggccctggactacgagcagctccagagcgtgaagctgtctatcgccgtgaagaacaaggccgagttccaccagtccgtgatctcccggtacagagtgcagagcacccctgtgaccatccaagtgattaacgtgcgcgagggcattgccttcagacccgccagcaagaccttcaccgtgcagaagggcatcagcagcaagaaactggtggactacatcctgggcacctatcaggccatcgacgaggacacaaacaaagccgcctccaacgtgaaatacgtgatgggcagaaacgacggcggctacctgatgatcgactccaagaccgccgagatcaagttcgtgaagaatatgaaccgggactccaccttcatcgtgaacaagaccatcacagccgaggtgctggctatcgacgagtataccggcaagaccagcaccggcacagtgtatgtgcgggtgcccgacttcaacgataactgccctacagccgtgctggaaaaggacgccgtgtgtagctctagccctagcgtggtcgtgtccgccagaacactgaacaacagatacacaggcccctacacattcgccctggaagatcagcctgtgaagctgcctgccgtgtggtccatcaccacactgaatgctacaagcgccctgctgagagcccaagagcaaattcctcctggcgtgtaccacatcagcctggtgctgacagacagccagaacaatagatgcgagatgcctcggagcctgacactggaagtgtgccagtgcgacaacagaggcatctgcggcacaagctaccccacaacaagccccggcacaagatacggcagacctcactctggaagaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1115 - DNA, 2664 bp, Artificial Sequence
  Polynucleotide encoding a Synthetic Immune Receptor (SIR)
atggccttaccagtgaccgccttgctcctgccgctggccttgctgctccacgccgccaggccggaccagaccgtcgtgacacagcctcctagcgcctctggcacaccaggccagagagtgaccatctcctgtagcggcagcagcagcaacatcggcagcaactacgtgtactggtatcagcaactgcccggcaccgcccccaagctgctgatctacagaagcaaccagcggcccagcggcgtgcccgatagattttctggcagcaagagcggcaccagcgccagcctggctatctctggacctagaagcgtggacgaggccgactactactgcgccgcctgggacgatagcctgaacggcgtggtgtttggcggaggcaccaagctgacagtgctgggtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagtctggggccgaagtgaagaaacccggcagctccgtgaaggtgtcctgcaaggcttccggcggcaccttcagcagctacgccatttcttgggtgcgccaggcccctggacagggcctggaatggatgggcggcatcatccccatctttggcaccgccaactacgcccagaaattccagggccgcgtgaccatcaccgccgacgagtctacaagcaccgcctacatggaactgagcagcctgcggagcgaggataccgccgtgtactactgtgccagaagaatccccccctactacggcatggacgtgtggggccagggaaccaccgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1116 - DNA, 2871 bp, Artificial Sequence
  Polynucleotide encoding a Synthetic Immune Receptor (SIR)
atggccttaccagtgaccgccttgctcctgccgctggccttgctgctccacgccgccaggccggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtgcagtctggcggaggggtcatgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgttaccgtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1117 - DNA, 2655 bp, Artificial Sequence
  Polynucleotide encoding a Synthetic Immune Receptor (SIR)
atggccttaccagtgaccgccttgctcctgccgctggccttgctgctccacgccgccaggccggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtgcagtctggcggaggggtcatgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgttaccgtgtcctctgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1118 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccgctcgaggaggacctgaacaaggtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgtgagctaccagcagggcgtgctgtctgccaccatcctgtacgagatcctgctgggcaaggccaccctgtacgccgtgctggtgtccgccctggtgctgatggctatggtgaagcggaaggacttcagggccaagcgatctggatctggagcaacaaacttctcactactcaaacaagcaggtgacgtggaggagaatcccgggcctactagcaccatggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1119 - DNA, 2649 bp, Artificial Sequence
  Polynucleotide encoding a Synthetic Immune Receptor (SIR)
atggccttaccagtgaccgccttgctcctgccgctggccttgctgctccacgccgccaggccgctcgaggaggacctgaacaaggtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgtgagctaccagcagggcgtgctgtctgccaccatcctgtacgagatcctgctgggcaaggccaccctgtacgccgtgctggtgtccgccctggtgctgatggctatggtgaagcggaaggacttcagggccaagcgatctggatctggagcaacaaacttctcactactcaaacaagcaggtgacgtggaggagaatcccgggcctactagcaccatggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1120 - DNA, 2877 bp, Artificial Sequence
  Polynucleotide encoding a Synthetic Immune Receptor (SIR)
atggccttaccagtgaccgccttgctcctgccgctggccttgctgctccacgccgccaggccgctcgaggaggacctgaacaaggtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgtgagctaccagcagggcgtgctgtctgccaccatcctgtacgagatcctgctgggcaaggccaccctgtacgccgtgctggtgtccgccctggtgctgatggctatggtgaagcggaaggacttcagggccaagcgatctggatctggagcaacaaacttctcactactcaaacaagcaggtgacgtggaggagaatcccgggcctactagcaccatggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1121 - DNA, 2868 bp, Artificial Sequence
  Polynucleotide encoding a Synthetic Immune Receptor (SIR)
atggccttaccagtgaccgccttgctcctgccgctggccttgctgctccacgccgccaggccgctcgaggaggacctgaacaaggtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgtgagctaccagcagggcgtgctgtctgccaccatcctgtacgagatcctgctgggcaaggccaccctgtacgccgtgctggtgtccgccctggtgctgatggctatggtgaagcggaaggacttcagggccaagcgatctggatctggagcaacaaacttctcactactcaaacaagcaggtgacgtggaggagaatcccgggcctactagcaccatggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1122 - DNA, 2664 bp, Artificial Sequence
  Polynucleotide encoding a Synthetic Immune Receptor (SIR)
atggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctctcgaggaggacctgaacaaggtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgtgagctaccagcagggcgtgctgtctgccaccatcctgtacgagatcctgctgggcaaggccaccctgtacgccgtgctggtgtccgccctggtgctgatggctatggtgaagcggaaggacttcagggccaagcgatctggatctggagcaacaaacttctcactactcaaacaagcaggtgacgtggaggagaatcccgggcctactagtatggactggatttggcgcatccttttccttgtcggcgctgctaccggcgcccattccttcgaaggcagcggaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1123 - DNA, 2655 bp, Artificial Sequence
  Polynucleotide encoding a Synthetic Immune Receptor (SIR)
atggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctctcgaggaggacctgaacaaggtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgtgagctaccagcagggcgtgctgtctgccaccatcctgtacgagatcctgctgggcaaggccaccctgtacgccgtgctggtgtccgccctggtgctgatggctatggtgaagcggaaggacttcagggccaagcgatctggatctggagcaacaaacttctcactactcaaacaagcaggtgacgtggaggagaatcccgggcctactagtatggactggatttggcgcatccttttccttgtcggcgctgctaccggcgcccattccttcgaaggcagcggaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1124 - DNA, 2664 bp, Artificial Sequence
  Polynucleotide encoding a Synthetic Immune Receptor (SIR)
atggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctctcgaggaggacctgaacaaggtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgtgagctaccagcagggcgtgctgtctgccaccatcctgtacgagatcctgctgggcaaggccaccctgtacgccgtgctggtgtccgccctggtgctgatggctatggtgaagcggaaggacttcagggccaagcgatctggatctggagcaacaaacttctcactactcaaacaagcaggtgacgtggaggagaatcccgggcctactagtatggactggatttggcgcatccttttccttgtcggcgctgctaccggcgcccattccttcgaaggcagcggaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1125 - DNA, 2655 bp, Artificial Sequence
  Polynucleotide encoding a Synthetic Immune Receptor (SIR)
atggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctctcgaggaggacctgaacaaggtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgtgagctaccagcagggcgtgctgtctgccaccatcctgtacgagatcctgctgggcaaggccaccctgtacgccgtgctggtgtccgccctggtgctgatggctatggtgaagcggaaggacttcagggccaagcgatctggatctggagcaacaaacttctcactactcaaacaagcaggtgacgtggaggagaatcccgggcctactagtatggactggatttggcgcatccttttccttgtcggcgctgctaccggcgcccattccttcgaaggcagcggaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1126 - DNA, 2877 bp, Artificial Sequence
  Polynucleotide encoding a Synthetic Immune Receptor (SIR)
atggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctctcgaggaggacctgaacaaggtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgtgagctaccagcagggcgtgctgtctgccaccatcctgtacgagatcctgctgggcaaggccaccctgtacgccgtgctggtgtccgccctggtgctgatggctatggtgaagcggaaggacttcagggccaagcgatctggatctggagcaacaaacttctcactactcaaacaagcaggtgacgtggaggagaatcccgggcctactagtatggactggatttggcgcatccttttccttgtcggcgctgctaccggcgcccattccttcgaaggcagcggaacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1127 - DNA, 2868 bp, Artificial Sequence
  Polynucleotide encoding a Synthetic Immune Receptor (SIR)
atggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctctcgaggaggacctgaacaaggtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgtgagctaccagcagggcgtgctgtctgccaccatcctgtacgagatcctgctgggcaaggccaccctgtacgccgtgctggtgtccgccctggtgctgatggctatggtgaagcggaaggacttcagggccaagcgatctggatctggagcaacaaacttctcactactcaaacaagcaggtgacgtggaggagaatcccgggcctactagtatggactggatttggcgcatccttttccttgtcggcgctgctaccggcgcccattccttcgaaggcagcggaacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1128 - DNA, 2607 bp, Artificial Sequence
  Polynucleotide encoding a Synthetic Immune Receptor (SIR)
atggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagctcgaggacctgaacaaggtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgtgagctaccagcagggcgtgctgtctgccaccatcctgtacgagatcctgctgggcaaggccaccctgtacgccgtgctggtgtccgccctggtgctgatggctatggtgaagcggaaggacttcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1129 - DNA, 2598 bp, Artificial Sequence
  Polynucleotide encoding a Synthetic Immune Receptor (SIR)
atggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagctcgaggacctgaacaaggtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgtgagctaccagcagggcgtgctgtctgccaccatcctgtacgagatcctgctgggcaaggccaccctgtacgccgtgctggtgtccgccctggtgctgatggctatggtgaagcggaaggacttcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1130 - DNA, 2859 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1131 - DNA, 2901 bp, Artificial Sequence
  Polynucleotide encoding a Synthetic Immune Receptor (SIR)
atggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1132 - DNA, 3132 bp, Artificial Sequence
  Polynucleotide encoding a Synthetic Immune Receptor (SIR)
atggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1133 - DNA, 3132 bp, Artificial Sequence
  Polynucleotide encoding a Synthetic Immune Receptor (SIR)
atggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggcccttccagtcactgccttgctgttgcctctggcgctcctgctccacgccgctagaccgggcatgagaaccgaggacctgcctaaggccgtggtgttcctggaaccccagtggtacagagtgctggaaaaggacagcgtgaccctgaagtgccagggcgcctacagccccgaggacaatagcacccagtggttccacaacgagagcctgatctccagccaggccagcagctacttcatcgacgccgccaccgtggacgacagcggcgagtatagatgccagaccaacctgagcaccctgagcgaccccgtgcagctggaagtgcacatcggatggctgctgctgcaggcccccagatgggtgttcaaagaagaggaccccatccacctgagatgccactcttggaagaacaccgccctgcacaaagtgacctacctgcagaacggcaagggcagaaagtacttccaccacaacagcgacttctacatccccaaggccaccctgaaggactccggctcctacttctgcagaggcctcgtgggcagcaagaacgtgtccagcgagacagtgaacatcaccatcacccagggcctggccgtgtctaccatcagcagctttttcccacccggctaccagacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1134 - DNA, 2691 bp, Artificial Sequence
  Polynucleotide encoding a Synthetic Immune Receptor (SIR)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1135 - DNA, 2721 bp, Artificial Sequence
  Polynucleotide encoding a Synthetic Immune Receptor (SIR)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1136 - DNA, 2694 bp, Artificial Sequence
  Polynucleotide encoding a Synthetic Immune Receptor (SIR)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagaggcggaggcggaagtggaggcggaggatctggcggcggaggctctgaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1137 - DNA, 2718 bp, Artificial Sequence
  Polynucleotide encoding a Synthetic Immune Receptor (SIR)
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacctggaaaccaccctgacacagagccctgccaccctgagtgtgtccccaggcgagagagtgaccctgagctgtagagccagccagagcgtgggcagcaacctggcctggtatcagcagaagttcggccaggcccccagactgctgatctacgacgccagcacaagagccaccggcatccccgccagattttctggcagcggctccggcaccgagttcaccctgaccatcagcagactggaacccgaggacttcgccgtgtactactgccaccagtacggcagcagccccagaacctttggacagggcaccaaggtggacatcaagcggggcggaggcggaagtggaggcggaggatctggcggcggaggctctcaggtgcaactggtgcagagcggagccgaagtgaagaaacctggggccagcgtgaaggtgtcctgcaaggccagcggctacacctttaccacctacggcatctcttgggtgcgccaggctcctggacagggactggaatggatgggctggatcagcgcctacaacggccacaccaactacgcccagatgctccagggcagagtgaccatgaccaccgacaccagcacctccaccgcctacatggaactgcggggcctgagaagcgacgacaccgccgtgtattattgcgccagagaagcctacgcctcctacggcagcggcagctactggaccgattattggggccagggcaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1138 - DNA, 3426 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcgccaccatggccctgcctgtgacagctctgctgctgcctctggcactgctgctgcacgccgccagacctgatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1139 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaactcgaggggaaaccaattcccaaccctcttctgggactggattcaaccggcagcggcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgtgagcagaaactgatctcggaagaggatgggagcggcatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1140 - DNA, 2673 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagactcgaggggaaaccaattcccaaccctcttctgggactggattcaaccggcagcggcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgtgagcagaaactgatctcggaagaggatgggagcggcatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1141 - DNA, 2649 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1142 - DNA, 2718 bp, Artificial Sequence
  Polynucleotide encoding a Synthetic Immune Receptor (SIR)
atggccttaccagtgaccgccttgctcctgccgctggccttgctgctccacgccgccaggccggacgaattcgaggtgcagctggtagaatccggcgggggacttgtacaggctggtggtagtctgagactgagctgtgtggcctccggcatcagcagcagcaagcggaacatgggatggtataggcaagcccctggtaagcagagggaatccgtggctacaatcagcagcggcggcaacaaggactacaccgacgccgtgaaggacaggttcaccatctccagggacaccaccaagaacaccgtgtacctgcagatgaactccctcaagcccgaggacaccgccgtgtactactgcaagatcgaggccggcacaggctgggccaccagaagaggctacacatactgggggcagggaacactggtgaccgtgagctccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaacttgtggagagcggtgggggctctgtgcaacctggcggcagtctgactctcagctgcggaacctcagggcgcacctttaatgtaatggggtggttcagacaagccccaggcaaggagcgggagtttgtcgctgccgtccgctggtccagtacggggatttattacactcaatacgcggattctgtgaagtccaggtttacaatttcccgcgataacgcgaaaaatacagtctacctggaaatgaatagcctgaaacccgaagatacagccgtgtattattgcgccgctgatacctataacagtaaccccgctcgctgggacggctacgacttcagagggcagggcacccaggtaacagtctccagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1143 - DNA, 2661 bp, Artificial Sequence
  Polynucleotide encoding a Synthetic Immune Receptor (SIR)
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggactggatttggcgcatccttttccttgtcggcgctgctaccggcgcgcattccgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaatggccttaccagtgaccgccttgctcctgccgctggccttgctgctccacgccgccaggccggacgaattcgaggtgcagctggtagaatccggcgggggacttgtacaggctggtggtagtctgagactgagctgtgtggcctccggcatcagcagcagcaagcggaacatgggatggtataggcaagcccctggtaagcagagggaatccgtggctacaatcagcagcggcggcaacaaggactacaccgacgccgtgaaggacaggttcaccatctccagggacaccaccaagaacaccgtgtacctgcagatgaactccctcaagcccgaggacaccgccgtgtactactgcaagatcgaggccggcacaggctgggccaccagaagaggctacacatactgggggcagggaacactggtgaccgtgagctccggatccaaagagagcagcggcggacccgacagccctgatacagagcctggaagctctgccggacctacccagaggcccagcgacaacagccacaatgaacacgcccctgccagccagggactgaaggccgagcacctgtacatcctgatcggcgtgtccgtggtgttcctgttctgcctgctgctgctggtgctgttctgtctgcaccggcagaaccagatcaagcagggacctcccagaagcaaggacgaggaacagaagcctcagcagaggcccgacctggccgtggacgtgctggaaagaacagccgacaaggccaccgtgaacggcctgcccgagaaggacagagagacagacacaagcgccctggccgctggcagctctcaggaagtgacatacgcccagctggaccactgggctctgacccagagaacagccagagccgtgtccccccagagcaccaaacctatggccgagagcatcacctacgccgccgtggctagacaccatatgtga

SEQ ID NO: 1144 - DNA, 3672 bp, Artificial Sequence
  Polynucleotide encoding a Synthetic Immune Receptor (SIR)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggagtgggtcaagttcgccaagccttgcagagaaggcgaggacaacagcaagcggaaccctatcgccaagatcaccagcgactaccaggccacacagaagatcacctaccggatctctggcgtgggcatcgaccagcctccattcggcatcttcgtggtggacaagaacaccggcgacatcaacatcaccgccatcgtggacagagaggaaacccctagcttcctgattacctgtagagccctgaacgcccagggcctcgatgtggaaaagcctctgatcctgaccgtgaagatcctggacatcaacgacaaccctccagtgttcagccagcagattttcatgggcgagatcgaggaaaacagcgccagcaacagcctggtcatgatcctgaatgccaccgacgccgacgagcccaaccacctgaatagcaagatcgccttcaagatcgtgtcccaagagcctgccggcacacccatgtttctgctgtccagaaataccggcgaagtgcggaccctgaccaatagcctggatagagagcaggccagcagctacagactggtggtgtctggcgctgacaaggatggcgagggactgagcacccagtgcgagtgcaacatcaaagtgaaggacgtgaacgacaacttccccatgttccgggacagccagtatagcgcccggatcgaagagaacatcctgagcagcgagctgctgcggttccaagtgaccgacctggacgaagagtacaccgacaactggctggccgtgtacttcttcaccagcggcaacgaaggcaactggttcgagatccagacagaccccaggaccaacgagggcatcctgaaggttgtgaaggccctggactacgagcagctccagagcgtgaagctgtctatcgccgtgaagaacaaggccgagttccaccagtccgtgatctcccggtacagagtgcagagcacccctgtgaccatccaagtgattaacgtgcgcgagggcattgccttcagacccgccagcaagaccttcaccgtgcagaagggcatcagcagcaagaaactggtggactacatcctgggcacctatcaggccatcgacgaggacacaaacaaagccgcctccaacgtgaaatacgtgatgggcagaaacgacggcggctacctgatgatcgactccaagaccgccgagatcaagttcgtgaagaatatgaaccgggactccaccttcatcgtgaacaagaccatcacagccgaggtgctggctatcgacgagtataccggcaagaccagcaccggcacagtgtatgtgcgggtgcccgacttcaacgataactgccctacagccgtgctggaaaaggacgccgtgtgtagctctagccctagcgtggtcgtgtccgccagaacactgaacaacagatacacaggcccctacacattcgccctggaagatcagcctgtgaagctgcctgccgtgtggtccatcaccacactgaatgctacaagcgccctgctgagagcccaagagcaaattcctcctggcgtgtaccacatcagcctggtgctgacagacagccagaacaatagatgcgagatgcctcggagcctgacactggaagtgtgccagtgcgacaacagaggcatctgcggcacaagctaccccacaacaagccccggcacaagatacggcagacctcactctggaagaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1145 - DNA, 2001 bp, Artificial Sequence
  Polynucleotide encoding a Synthetic Immune Receptor (SIR)
atggccttaccagtgaccgccttgctcctgccgctggccttgctgctccacgccgccaggccggaacagaaactcatcagtgaagaagacctggaattccaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgggcggaggcggaagtggaggcggaggatctggcggcggaggctctcagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1146 - DNA, 3885 bp, Artificial Sequence
  Polynucleotide encoding a Synthetic Immune Receptor (SIR)
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggagtgggtcaagttcgccaagccttgcagagaaggcgaggacaacagcaagcggaaccctatcgccaagatcaccagcgactaccaggccacacagaagatcacctaccggatctctggcgtgggcatcgaccagcctccattcggcatcttcgtggtggacaagaacaccggcgacatcaacatcaccgccatcgtggacagagaggaaacccctagcttcctgattacctgtagagccctgaacgcccagggcctcgatgtggaaaagcctctgatcctgaccgtgaagatcctggacatcaacgacaaccctccagtgttcagccagcagattttcatgggcgagatcgaggaaaacagcgccagcaacagcctggtcatgatcctgaatgccaccgacgccgacgagcccaaccacctgaatagcaagatcgccttcaagatcgtgtcccaagagcctgccggcacacccatgtttctgctgtccagaaataccggcgaagtgcggaccctgaccaatagcctggatagagagcaggccagcagctacagactggtggtgtctggcgctgacaaggatggcgagggactgagcacccagtgcgagtgcaacatcaaagtgaaggacgtgaacgacaacttccccatgttccgggacagccagtatagcgcccggatcgaagagaacatcctgagcagcgagctgctgcggttccaagtgaccgacctggacgaagagtacaccgacaactggctggccgtgtacttcttcaccagcggcaacgaaggcaactggttcgagatccagacagaccccaggaccaacgagggcatcctgaaggttgtgaaggccctggactacgagcagctccagagcgtgaagctgtctatcgccgtgaagaacaaggccgagttccaccagtccgtgatctcccggtacagagtgcagagcacccctgtgaccatccaagtgattaacgtgcgcgagggcattgccttcagacccgccagcaagaccttcaccgtgcagaagggcatcagcagcaagaaactggtggactacatcctgggcacctatcaggccatcgacgaggacacaaacaaagccgcctccaacgtgaaatacgtgatgggcagaaacgacggcggctacctgatgatcgactccaagaccgccgagatcaagttcgtgaagaatatgaaccgggactccaccttcatcgtgaacaagaccatcacagccgaggtgctggctatcgacgagtataccggcaagaccagcaccggcacagtgtatgtgcgggtgcccgacttcaacgataactgccctacagccgtgctggaaaaggacgccgtgtgtagctctagccctagcgtggtcgtgtccgccagaacactgaacaacagatacacaggcccctacacattcgccctggaagatcagcctgtgaagctgcctgccgtgtggtccatcaccacactgaatgctacaagcgccctgctgagagcccaagagcaaattcctcctggcgtgtaccacatcagcctggtgctgacagacagccagaacaatagatgcgagatgcctcggagcctgacactggaagtgtgccagtgcgacaacagaggcatctgcggcacaagctaccccacaacaagccccggcacaagatacggcagacctcactctggaagaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1147-1155 - skipped (9 entries)

SEQ ID NO: 1156 - DNA, 1983 bp, Artificial Sequence
  Polynucleotide encoding a Synthetic Immune Receptor (SIR)
atggccttaccagtgaccgccttgctcctgccgctggccttgctgctccacgccgccaggccggaacagaaactcatcagtgaagaagacctggaattcgacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagaggcggaggcggaagtggaggcggaggatctggcggcggaggctctcaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1157-1160 - skipped (4 entries)

SEQ ID NO: 1161 - DNA, 2676 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagagccccagcagcctgaccatgagcgtgggccagaaagtgaccatgtcctgcaagagcagccacagcctgctgaacagccggaaccagaagaactacctggcctggttccagcagaagcccggccagtcccccaagctgctggtgtacttcgcaagcacccgcgagagcggcgtgcccgacagattcatcggcagcggctccggcaccgacttcaccctgaccatcagcaacgtgcaggccgaggacctggccgactacttctgccagcagcactacaccaccctgcccaccttcggcggaggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctgggcgcgccatggactggatttggcgcatccttttccttgtcggcgctgctaccggcgcgcattccttcgaacagatccagctggtgcagagcggccctgacctgaagaaacccggcgagacagtgaagatcagttgcaaggcctccggctacaccttcaccaacacaggcatgaactgggtcaagcaggcccctggcaagggcctgaagtggatgggctggatcaacacctacaccggcgagcccacctacgccgacgacttcaagggccggttcaccttcagcctggaaaccagcgccagcaccgcctacctgcagatcaacaacctgaagaacgaggacaccgccacctatttctgcaccagatggggctacggcagcagcctgtactacgccatggactactggggccagggcaccagcgtgaccgtgtcctctcgcgtagagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggcccccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1162 - DNA, 1953 bp, Artificial Sequence
  Polynucleotide encoding a Synthetic Immune Receptor (SIR)
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcaacgcgtgagcagaaactgatctcggaagaggatgggagcggcatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1163 - DNA, 2640 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1164 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1165 - DNA, 2859 bp, Artificial Sequence
  Polynucleotide encoding a Synthetic Immune Receptor (SIR)
atggccttaccagtgaccgccttgctcctgccgctggccttgctgctccacgccgccaggccggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1166 - DNA, 3060 bp, Artificial Sequence
  Polynucleotide encoding a Synthetic Immune Receptor (SIR)
atggccttaccagtgaccgccttgctcctgccgctggccttgctgctccacgccgccaggccggaggttcagttggtcgaatcaggcgggggcctcgtccaacccggcggaagcctgcggctgtcttgcgcagcaagtggtagtgtgttcaagatcaacgttatggcctggtatcgccaggctccgggaaaagggagagagctggttgcggggatcattagcggtggctccaccagctacgctgacagtgtgaagggaaggttcactatatcacgcgacaacgcaaagaatacattgtacctccagatgaatagcttgcggcccgaagacacggcagtctactattgtgcctttatcacaacagagagcgactatgacctgggccgccggtattgggggcagggaacccttgtgaccgtttcatccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1167 - DNA, 2715 bp, Artificial Sequence
  Polynucleotide encoding a Synthetic Immune Receptor (SIR)
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcgccaccatggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtgagcagaaactgatctcggaagaggatgggagcggcatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagcagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1168 - DNA, 3030 bp, Artificial Sequence
  Polynucleotide encoding a Synthetic Immune Receptor (SIR)
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcgccaccatggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1169 - DNA, 1959 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1170 - DNA, 2721 bp, Artificial Sequence
  Polynucleotide encoding a Synthetic Immune Receptor (SIR)
atggccttaccagtgaccgccttgctcctgccgctggccttgctgctccacgccgccaggccggacgaattcgaggtgcagctggtagaatccggcgggggacttgtacaggctggtggtagtctgagactgagctgtgtggcctccggcatcagcagcagcaagcggaacatgggatggtataggcaagcccctggtaagcagagggaatccgtggctacaatcagcagcggcggcaacaaggactacaccgacgccgtgaaggacaggttcaccatctccagggacaccaccaagaacaccgtgtacctgcagatgaactccctcaagcccgaggacaccgccgtgtactactgcaagatcgaggccggcacaggctgggccaccagaagaggctacacatactgggggcagggaacactggtgaccgtgagctccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1171 - DNA, 2703 bp, Artificial Sequence
  Polynucleotide encoding a Synthetic Immune Receptor (SIR)
atggccttaccagtgaccgccttgctcctgccgctggccttgctgctccacgccgccaggccggacgaattcgaggtgcagctggtagaatccggcgggggacttgtacaggctggtggtagtctgagactgagctgtgtggcctccggcatcagcagcagcaagcggaacatgggatggtataggcaagcccctggtaagcagagggaatccgtggctacaatcagcagcggcggcaacaaggactacaccgacgccgtgaaggacaggttcaccatctccagggacaccaccaagaacaccgtgtacctgcagatgaactccctcaagcccgaggacaccgccgtgtactactgcaagatcgaggccggcacaggctgggccaccagaagaggctacacatactgggggcagggaacactggtgaccgtgagctccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1172 - DNA, 2361 bp, Artificial Sequence
  Polynucleotide encoding a Synthetic Immune Receptor (SIR)
atggccttaccagtgaccgccttgctcctgccgctggccttgctgctccacgccgccaggccggatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcccattccttcgaaggcagcggaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1173 - DNA, 2034 bp, Artificial Sequence
  Polynucleotide encoding a Synthetic Immune Receptor (SIR)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgagggcggaggcggaagtggaggcggaggatctggcggcggaggctctttcgaagaggtgcaactggtggaatccgggggaggcagcgtgcaggctgggggatcactgagactgtcttgtgctgcctccggcgacacctacggcagctattggatgggatggtttcggcaggctcccggaaaagaacgggaaggcgtggccgccatcaacagaggcggcggatacaccgtgtacgccgactctgtgaagggcagattcacaatctccagagacacagccaagaatactgtgtacctgcagatgaactccctgcgccccgacgataccgccgactattattgcgccgcttccggcgtgctgggcggcctgcatgaggactggttcaattattggggacagggaacacttgtgacagtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1174 - DNA, 2733 bp, Artificial Sequence
  Polynucleotide encoding a Synthetic Immune Receptor (SIR)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1175 - DNA, 2727 bp, Artificial Sequence
  Polynucleotide encoding a Synthetic Immune Receptor (SIR)
atggccctgcccgtgacagccctgctgctgcctctggctctgctgctgcacgccgccagacccgatgaattcgaggtgcagctcgtagaatctggaggtggttccgtgcaagccggaggatcattgcgactgacctgcgcagcgagcggatctacttctcgctcttacggtatgggatggttcagacaggctcctgggaaagagcgcgagttcgtttcaggcatctcctggaggggggacagcaccggctacgcagatagcgtgaagggcaggttcacgatcagccgagacaacgccaaaaacaccgtcgatctgcaaatgaatagtctgaagcccgaagatactgcgatctactactgtgccgccgcagcagggtccacctggtacggcacactctacgagtacgactactgggggcagggaaccctggtaaccgtgtcctctctcgagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactggtggaatccgggggaggcagcgtgcaggctgggggatcactgagactgtcttgtgctgcctccggcgacacctacggcagctattggatgggatggtttcggcaggctcccggaaaagaacgggaaggcgtggccgccatcaacagaggcggcggatacaccgtgtacgccgactctgtgaagggcagattcacaatctccagagacacagccaagaatactgtgtacctgcagatgaactccctgcgccccgacgataccgccgactattattgcgccgcttccggcgtgctgggcggcctgcatgaggactggttcaattattggggacagggaacacttgtgacagtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1176 - DNA, 2712 bp, Artificial Sequence
  Polynucleotide encoding a Synthetic Immune Receptor (SIR)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtggaatctgggggcggactggtgcagccaggcggaagtctgaggctgtcttgtgccgcctccggcagcatcttcggcttcaacgacatggcctggtatcggcaggctcccggaaaacagcgcgagctggtggctctgattagcagagtgggcgtgaccagcagcgccgactctgtgaagggcagattcacaatctccagagtgaacgccaaggatacagtgtacctccagatgaactctctgaaacctgaggatacagcagtgtactattgctacatggaccagcggctggacggcagcacactggcctactggggacagggaactcaagtgacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1177 - DNA, 2511 bp, Artificial Sequence
  Polynucleotide encoding a Synthetic Immune Receptor (SIR)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatacgccaaagagatgcggaacgcctactgggagatcgccctgctgcccaatctgaccaaccagcagaagagagcccccatcagaaagctgtacgacgacccctcccagagcagcgagctgctgtctgaggctaaaaaactgaacgatagccagacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1178 - DNA, 2712 bp, Artificial Sequence
  Polynucleotide encoding a Synthetic Immune Receptor (SIR)
atggccctgcccgtgacagccctgctgctgcctctggctctgctgctgcacgccgccagacccgatgaattcgaggtgcagctcgtagaatctggaggtggttccgtgcaagccggaggatcattgcgactgacctgcgcagcgagcggatctacttctcgctcttacggtatgggatggttcagacaggctcctgggaaagagcgcgagttcgtttcaggcatctcctggaggggggacagcaccggctacgcagatagcgtgaagggcaggttcacgatcagccgagacaacgccaaaaacaccgtcgatctgcaaatgaatagtctgaagcccgaagatactgcgatctactactgtgccgccgcagcagggtccacctggtacggcacactctacgagtacgactactgggggcagggaaccctggtaaccgtgtcctctctcgagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtggaatctgggggcggactggtgcagccaggcggaagtctgaggctgtcttgtgccgcctccggcagcatcttcggcttcaacgacatggcctggtatcggcaggctcccggaaaacagcgcgagctggtggctctgattagcagagtgggcgtgaccagcagcgccgactctgtgaagggcagattcacaatctccagagtgaacgccaaggatacagtgtacctccagatgaactctctgaaacctgaggatacagcagtgtactattgctacatggaccagcggctggacggcagcacactggcctactggggacagggaactcaagtgacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1179 - DNA, 2694 bp, Artificial Sequence
  Polynucleotide encoding a Synthetic Immune Receptor (SIR)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagtctggcggagggctggtgcagccagggggatctctgagactgagctgtgccgccagcgacttcgacttcgccgcctacgagatgagctgggtgcgccaggctcctggacagggactggaatgggtggccatcatcagccacgacggcatcgacaagtattacaccgacagcgtgaagggccggttcaccatcagccgggacaacagcaagaacaccctgtacctgcagatgaataccctgcgggccgaggacaccgccacctactattgcctgagactgggagccgtgggccagggcacacttgtgacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1180 - DNA, 2061 bp, Artificial Sequence
  Polynucleotide encoding a Synthetic Immune Receptor (SIR)
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctctcgagggaggaggcggctccgggggaggcggaagtggaggcggaggatctgggtctggaggaagcggatctggaggctcagggtcagggggctcaggcagtggaggctctttcgaagtgcaactggtggaatctgggggcggactggtgcagccaggcggaagtctgaggctgtcttgtgccgcctccggcagcatcttcggcttcaacgacatggcctggtatcggcaggctcccggaaaacagcgcgagctggtggctctgattagcagagtgggcgtgaccagcagcgccgactctgtgaagggcagattcacaatctccagagtgaacgccaaggatacagtgtacctccagatgaactctctgaaacctgaggatacagcagtgtactattgctacatggaccagcggctggacggcagcacactggcctactggggacagggaactcaagtgacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1181 - DNA, 2313 bp, Artificial Sequence
  Polynucleotide encoding a Synthetic Immune Receptor (SIR)
atggccctgcccgtgacagccctgctgctgcctctggctctgctgctgcacgccgccagacccgatgaattcgtggacaacaagttcaacaaagagcggtacagcgcctactacgagatttggcaactgcccaacctgaacgtgcggcagaaggccgccttcatcggatctctgcaggacgaccctagccagagcgccaatctgctggccgaggccaagaagctgaacgacgcccaggcccctaaactcgagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatacgccaaagagatgcggaacgcctactgggagatcgccctgctgcccaatctgaccaaccagcagaagagagcccccatcagaaagctgtacgacgacccctcccagagcagcgagctgctgtctgaggctaaaaaactgaacgatagccagacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1182 - DNA, 2076 bp, Artificial Sequence
  Polynucleotide encoding a Synthetic Immune Receptor (SIR)
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtctcgagggaggaggcggctccgggggaggcggaagtggaggcggaggatctgggtctggaggaagcggatctggaggctcagggtcagggggctcaggcagtggaggctctttcgaagtgcaactggtggaatctggaggctctctggtgcagccagggggaagcctgagactgtcttgtgccgcttccggcttcaccttcgacgactacgccatgagctgggtgcgccaggtgccaggcaaaggcctggaatgggtgtccagcatcaactggagcggcacccacaccgattacgccgactccgtgaaaggcagattcacaatcagcagaaacaacgccaacaataccctgtacctgcagatgaactccctgaagtctgaggatacagcagtgtattattgcgccaagaactggcgggacgccggcaccacttggtttgagaaaagcggctctgccggacagggaacccaagtgacagtgtcctccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1183 - DNA, 1962 bp, Artificial Sequence
  Polynucleotide encoding a Synthetic Immune Receptor (SIR)
atggccttaccagtgaccgccttgctcctgccgctggccttgctgctccacgccgccaggccggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1184 - DNA, 2862 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgatatctggggccagggcacaatggtcaccgtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1185 - DNA, 2460 bp, Artificial Sequence
  Polynucleotide encoding a Synthetic Immune Receptor (SIR)
atggccttaccagtgaccgccttgctcctgccgctggccttgctgctccacgccgccaggccggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccacgcgtatccagaaccctgatcctgccgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1186 - DNA, 2547 bp, Artificial Sequence
  Polynucleotide encoding a Synthetic Immune Receptor (SIR)
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggcccttccagtcactgccttgctgttgcctctggcgctcctgctccacgccgctagaccgggcatgagaaccgaggacctgcctaaggccgtggtgttcctggaaccccagtggtacagagtgctggaaaaggacagcgtgaccctgaagtgccagggcgcctacagccccgaggacaatagcacccagtggttccacaacgagagcctgatctccagccaggccagcagctacttcatcgacgccgccaccgtggacgacagcggcgagtatagatgccagaccaacctgagcaccctgagcgaccccgtgcagctggaagtgcacatcggatggctgctgctgcaggcccccagatgggtgttcaaagaagaggaccccatccacctgagatgccactcttggaagaacaccgccctgcacaaagtgacctacctgcagaacggcaagggcagaaagtacttccaccacaacagcgacttctacatccccaaggccaccctgaaggactccggctcctacttctgcagaggcctcgtgggcagcaagaacgtgtccagcgagacagtgaacatcaccatcacccagggcctggccgtgtctaccatcagcagctttttcccacccggctaccagacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1187-1191 - skipped (5 entries)

SEQ ID NO: 1192 - DNA, 1920 bp, Artificial Sequence
  Polynucleotide encoding a Synthetic Immune Receptor (SIR)
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgtgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1193 - DNA, 2052 bp, Artificial Sequence
  Polynucleotide encoding a Synthetic Immune Receptor (SIR)
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1194 - DNA, 1923 bp, Artificial Sequence
  Polynucleotide encoding a Synthetic Immune Receptor (SIR)
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgccgtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1195 - DNA, 2055 bp, Artificial Sequence
  Polynucleotide encoding a Synthetic Immune Receptor (SIR)
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1196 - DNA, 2043 bp, Artificial Sequence
  Polynucleotide encoding a Synthetic Immune Receptor (SIR)
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctaga

SEQ ID NO: 1197 - DNA, 2043 bp, Artificial Sequence
  Polynucleotide encoding a Synthetic Immune Receptor (SIR)
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctaga

SEQ ID NO: 1198 - DNA, 2058 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctaga

SEQ ID NO: 1199 - DNA, 2067 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctaga

SEQ ID NO: 1200 - DNA, 2649 bp, Artificial Sequence; identical to SEQ ID NO: 930
  Polynucleotide encoding a Synthetic Immune Receptor (SIR)

SEQ ID NO: 1201 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1202 - DNA, 2655 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1203 - DNA, 2676 bp, Artificial Sequence
  Polynucleotide encoding a Synthetic Immune Receptor (SIR)
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1204 - DNA, 2673 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccaggccgctcccagcatccctgtgacacctggcgagagcgtgtccatctcctgccggtctagcaagagcctgctgaacagcaacggcaatacctacctgtactggttcctccagcggccaggccagtctccccaactgctgatctaccggatgagcaacctggcctccggcgtgcccgatagattttctggcagcggctccggcaccgccttcaccctgagaatcagcagagtggaagccgaggacgtgggcgtgtactactgtatgcagcacctggaataccccttcaccttcggagccggcaccaagctggaactgaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggccctgagctgattaagcctggggccagcgtgaagatgagctgcaaggccagcggctacaccttcaccagctacgtgatgcactgggtcaagcagaagcccggccagggcctggaatggatcggctacatcaacccctacaacgatggcaccaagtacaacgagaagttcaagggcaaggccaccctgaccagcgacaagagcagcagcaccgcctacatggaactgagcagcctgacaagcgaggacagcgccgtgtactattgcgccagaggcacctactactacggcagccgggtgttcgactattggggccagggcaccacactgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1205 - DNA, 2649 bp, Artificial Sequence
  Polynucleotide encoding a Synthetic Immune Receptor (SIR)
atggccttaccagtgaccgccttgctcctgccgctggccttgctgctccacgccgccaggccggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1206 - DNA, 2679 bp, Artificial Sequence
  Polynucleotide encoding a Synthetic Immune Receptor (SIR)
atggccttaccagtgaccgccttgctcctgccgctggccttgctgctccacgccgccaggccggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1207 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1208 - DNA, 2673 bp, Artificial Sequence
  Polynucleotide encoding a Synthetic Immune Receptor (SIR)
atgaggctccctgctcagctcctggggctgctaatgctctgggtctctggaagcagtggggatgttgtgatgactcagtctccactctccctgcccgtcacccctggagcgccggcctccatctcctgcagatccagtcagagcattgtacatagtaatggaaacacctatttagagtggtatcttcaaaagccagggcagtctccaaagctcctgatctataaagtttccaaccgattttctggagtccctgacaggttcagtggaagtggatcaggcacagattttacactgagaatcagcagagtggaggctgaggatgttggaatttattactgctttcaaggttcacatgttcctccgacgttcggccctgggaccaaattggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtggagtctgggggaggcttggtccagcctggggggtccctgagactctcctgttcagcctctggattcacctttagtagctttggaatgcactgggtccgccaggctccagggaaggggctggaatgggtggcctacattagtagtggcagtagtaccatctactatggagacaccgtgaagggccgattcaccatctccagagacaacgccaagaactcactgtttctgcaaatgagcagcctgagagccgaggacacggccgtgtattattgtgcgagagaggggggatattactacggaaggagttactatactatggactactggggccaagggaccacggtcaccgtctccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1209 - DNA, 3615 bp, Artificial Sequence
  Polynucleotide encoding a Synthetic Immune Receptor (SIR)
atggccttaccagtgaccgccttgctcctgccgctggccttgctgctccacgccgccaggccggccagaaagagaacccagcccaccttcggcttcaccgtgaactggaagttcagcgagagcaccaccgtgttcaccggccagtgcttcatcgaccggaacggcaaagaggtgctgaaaaccatgtggctgctgcggagcagcgtgaacgacatcggcgacgactggaaggccaccagagtgggcatcaacatcttcacccggctgcggacacagaaagagggcggctctggcggaagcgccagaaagtgtagcctgaccggcaagtggaccaacgacctgggcagcaacatgaccatcggagccgtgaacagcagaggcgagtttaccggcacctacatcaccgccgtgaccgccaccagcaacgagatcaaagagagccccctgcacggcacccagaacaccatcaacaagagcggcggcagcacaacagtgtttacaggacagtgctttattgaccgcaatgggaaagaagtgctgaaaacaatgtggctgctgaggtcctccgtgaatgacattggagatgattggaaagctacaagagtggggattaacatttttaccagactgaggacccagaaagaagggggcagcggaggctccgccagaaaatgctctctgacagggaagtggacaaatgatctggggtccaatatgacaatcggcgctgtgaactctcggggcgagttcactggaacatatattacagccgtgacagctacctctaacgaaatcaaagagtctcctctgcacgggacacagaataccattaacaaacggacccagcctacatttgggtttacagtgaattggaaattctccgagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagccagaaagagaacccagcccaccttcggcttcaccgtgaactggaagttcagcgagagcaccaccgtgttcaccggccagtgcttcatcgaccggaacggcaaagaggtgctgaaaaccatgtggctgctgcggagcagcgtgaacgacatcggcgacgactggaaggccaccagagtgggcatcaacatcttcacccggctgcggacacagaaagagggcggctctggcggaagcgccagaaagtgtagcctgaccggcaagtggaccaacgacctgggcagcaacatgaccatcggagccgtgaacagcagaggcgagtttaccggcacctacatcaccgccgtgaccgccaccagcaacgagatcaaagagagccccctgcacggcacccagaacaccatcaacaagagcggcggcagcacaacagtgtttacaggacagtgctttattgaccgcaatgggaaagaagtgctgaaaacaatgtggctgctgaggtcctccgtgaatgacattggagatgattggaaagctacaagagtggggattaacatttttaccagactgaggacccagaaagaagggggcagcggaggctccgccagaaaatgctctctgacagggaagtggacaaatgatctggggtccaatatgacaatcggcgctgtgaactctcggggcgagttcactggaacatatattacagccgtgacagctacctctaacgaaatcaaagagtctcctctgcacgggacacagaataccattaacaaacggacccagcctacatttgggtttacagtgaattggaaattctccgagacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1210 - DNA, 2664 bp, Artificial Sequence
  Polynucleotide encoding a Synthetic Immune Receptor (SIR)
atggccttaccagtgaccgccttgctcctgccgctggccttgctgctccacgccgccaggccggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1211 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1212 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1213 - DNA, 2646 bp, Artificial Sequence
  Polynucleotide encoding a Synthetic Immune Receptor (SIR)
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1214 - DNA, 2640 bp, Artificial Sequence
  Polynucleotide encoding a Synthetic Immune Receptor (SIR)
atggccttaccagtgaccgccttgctcctgccgctggccttgctgctccacgccgccaggccgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1215 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1216 - DNA, 3033 bp, Artificial Sequence
  Polynucleotide encoding a Synthetic Immune Receptor (SIR)
atggttaggggcgttccattcagacatctgcttctggtcttgcagcttgcactcttgcccgctgccacccagggcaaaaaagtggtgctgggcaagaaaggcgacaccgtggaactgacctgcaccgccagccagaagaagtccatccagttccactggaagaacagcaaccagatcaagatcctgggcaaccagggcagcttcctgaccaagggacccagcaagctgaacgacagagccgacagcagacggtccctgtgggaccagggcaatttcccactgattatcaagaacctgaagatcgaggacagcgacacctacatctgcgaggtggaagatcagaaagaagaggtgcaactgctggtgttcggcctgaccgccaactccgacacccatctgctccagggccagagcctgaccctgacactggaaagccctccaggcagctcccccagcgtgcagtgtagaagcccacgaggcaagaacatccagggaggcaaaacattgtcagtgtcccaactggaactccaggactccggcacctggacctgtaccgtgctccagaaccagaaaaaggtggagttcaagatcgacatcgtggtgctggccttccagaaagcctctctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaatctaccaggaactgacacaactgaaggccgccgtggaacggctgtgccacccttgtccttgggagtggaccttctttcagggcaactgctacttcatgagcaacagccagcggaactggcacgacagcatcaccgcctgcaaagaagtgggagcccaactggtcgtgattaagagcgccgaggaacagaacttcctccaactccagagcagcagaagcaacagattcacctggatgggcctgagcgacctgaaccaggaaggcacctggcagtgggtggacggatctcctctgctgcccagcttcaagcagtattggaaccggggcgagcccaacaacgtgggcgaagaggattgcgccgagttcagcggcaacggctggaacgacgacaagtgcaacctggctaagttctggatctgcaagaagtccgccgcctcctgtagccgggatgaggaacagttcctgagccctgcccctgccacccctaatcctccaccagctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1217 - DNA, 2661 bp, Artificial Sequence
  Polynucleotide encoding a Synthetic Immune Receptor (SIR)
atggccttaccagtgaccgccttgctcctgccgctggccttgctgctccacgccgccaggccggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1218 - DNA, 2661 bp, Artificial Sequence; identical to SEQ ID NO: 1217
  Polynucleotide encoding a Synthetic Immune Receptor (SIR)

SEQ ID NO: 1219 - DNA, 3123 bp, Artificial Sequence
  Polynucleotide encoding a Synthetic Immune Receptor (SIR)
atggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggcccttccagtcactgccttgctgttgcctctggcgctcctgctccacgccgctagaccgggcatgagaaccgaggacctgcctaaggccgtggtgttcctggaaccccagtggtacagagtgctggaaaaggacagcgtgaccctgaagtgccagggcgcctacagccccgaggacaatagcacccagtggttccacaacgagagcctgatctccagccaggccagcagctacttcatcgacgccgccaccgtggacgacagcggcgagtatagatgccagaccaacctgagcaccctgagcgaccccgtgcagctggaagtgcacatcggatggctgctgctgcaggcccccagatgggtgttcaaagaagaggaccccatccacctgagatgccactcttggaagaacaccgccctgcacaaagtgacctacctgcagaacggcaagggcagaaagtacttccaccacaacagcgacttctacatccccaaggccaccctgaaggactccggctcctacttctgcagaggcctcgtgggcagcaagaacgtgtccagcgagacagtgaacatcaccatcacccagggcctggccgtgtctaccatcagcagctttttcccacccggctaccagacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1220 - DNA, 2892 bp, Artificial Sequence
  Polynucleotide encoding a Synthetic Immune Receptor (SIR)
atggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1221 - DNA, 2661 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1222 - DNA, 2667 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1223 - DNA, 2670 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1224 - DNA, 2646 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1225 - DNA, 2664 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1226 - DNA, 2643 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1227 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1228 - DNA, 2649 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1229 - DNA, 2679 bp, Artificial Sequence
  Polynucleotide encoding a Synthetic Immune Receptor (SIR)
atggccttaccagtgaccgccttgctcctgccgctggccttgctgctccacgccgccaggccggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1230 - DNA, 2667 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1231 - DNA, 2679 bp, Artificial Sequence
  Polynucleotide encoding a Synthetic Immune Receptor (SIR)
atggccttaccagtgaccgccttgctcctgccgctggccttgctgctccacgccgccaggccggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagagccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1232 - DNA, 2634 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1233 - DNA, 2661 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1234 - DNA, 2649 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1235 - DNA, 2673 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1236 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1237 - DNA, 2643 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1238 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1239 - DNA, 2640 bp, Artificial Sequence
  Polynucleotide encoding a Synthetic Immune Receptor (SIR)
atggccttaccagtgaccgccttgctcctgccgctggccttgctgctccacgccgccaggccgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1240 - DNA, 2670 bp, Artificial Sequence
  Polynucleotide encoding a Synthetic Immune Receptor (SIR)
atggccttaccagtgaccgccttgctcctgccgctggccttgctgctccacgccgccaggccggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1241 - DNA, 2643 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1242 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1243 - DNA, 2682 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1244 - DNA, 2673 bp, Artificial Sequence
  Polynucleotide encoding a Synthetic Immune Receptor (SIR)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1245 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1246 - DNA, 2628 bp, Artificial Sequence
  Polynucleotide encoding a Synthetic Immune Receptor (SIR)
atggccttaccagtgaccgccttgctcctgccgctggccttgctgctccacgccgccaggccgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1247 - DNA, 2643 bp, Artificial Sequence
  Polynucleotide encoding a Synthetic Immune Receptor (SIR)
atggccttaccagtgaccgccttgctcctgccgctggccttgctgctccacgccgccaggccgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1248 - DNA, 2679 bp, Artificial Sequence
  Polynucleotide encoding a Synthetic Immune Receptor (SIR)
atggaaatgttccagggcctgctgctgctcctgctgctttctatgggaggcacatgggccagcagagagatgctgaggcccagatgcagacccatcaatgccacactggccgtggaaaaagagggctgccctgtctgcatcaccgtgaacaccacaatctgcgccggctactgccccaccatgacaagagttctgcaaggcgtgctgcccgctctgcctcaggtcgtgtgcaactatcgggacgtccgcttcgagagcatcagactgcctggatgtcccagaggcgtgaaccctgtggtgtcttatgccgtggctctgagctgtcagtgcgccctgtgtagaagaagcaccaccgattgcggcggacccaaggatcaccctctgacctgtgacgaccctagattccaggccagcagcagctctaaagcccctccaccttctctgccatctccaagcagactgcccggacctagcgacacacctattctgcctcaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1249 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1250 - DNA, 2667 bp, Artificial Sequence
  Polynucleotide encoding a Synthetic Immune Receptor (SIR)
atggccttaccagtgaccgccttgctcctgccgctggccttgctgctccacgccgccaggccggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1251 - DNA, 2700 bp, Artificial Sequence
  Polynucleotide encoding a Synthetic Immune Receptor (SIR)
atggccttaccagtgaccgccttgctcctgccgctggccttgctgctccacgccgccaggccggacctgaacttcatgctgacccagccccacagcgtgtccggcagccctggaaagaccgtgaccatctcctgcaccagaagcaccggcagcatcaccagcaactacgtgcactggtatcagcagaggcccggcagcagccctaccaccgtgatctgcgaggacaacgagaggccaagcggcgtgcccgatagattcagcggctccatcgacatcagcagcaacagcgccagcctgaccatcagcggcctgaaaaccgaggacgaggccgactactactgccagagctacgacgacagcaaccacatctccgtgttcggcaccgggaccaaagtgaccgtgctgggacagcccaaggccaatcctctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcaggaatctggccctggcctcgtgaagcccagcgagacactgagcctgacctgcacagtgtccggcggcagcattagcagcagcaattactactggggctggattcggcagccccctggcaagggactggaatggatcggagccatctactacagcggcagcacctactacaaccccagcctgaagtccagagtggctatcagcgtggacaccagcaagaaccagttctccctgaagctgagcagcgtgacagccgccgataccgccgtgtactactgcgccagacggatcggagtggccggacagtggtacttcgacctgtggggcagaggaaccctcgtgaccgtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1252 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1253 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1254 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1255 - DNA, 2670 bp, Artificial Sequence
  Polynucleotide encoding a Synthetic Immune Receptor (SIR)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1256 - DNA, 2670 bp, Artificial Sequence
  Polynucleotide encoding a Synthetic Immune Receptor (SIR)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1257 - DNA, 2691 bp, Artificial Sequence
  Polynucleotide encoding a Synthetic Immune Receptor (SIR)
atggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1258 - DNA, 2922 bp, Artificial Sequence
  Polynucleotide encoding a Synthetic Immune Receptor (SIR)
atggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1259 - DNA, 2922 bp, Artificial Sequence
  Polynucleotide encoding a Synthetic Immune Receptor (SIR)
atggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggcccttccagtcactgccttgctgttgcctctggcgctcctgctccacgccgctagaccgggcatgagaaccgaggacctgcctaaggccgtggtgttcctggaaccccagtggtacagagtgctggaaaaggacagcgtgaccctgaagtgccagggcgcctacagccccgaggacaatagcacccagtggttccacaacgagagcctgatctccagccaggccagcagctacttcatcgacgccgccaccgtggacgacagcggcgagtatagatgccagaccaacctgagcaccctgagcgaccccgtgcagctggaagtgcacatcggatggctgctgctgcaggcccccagatgggtgttcaaagaagaggaccccatccacctgagatgccactcttggaagaacaccgccctgcacaaagtgacctacctgcagaacggcaagggcagaaagtacttccaccacaacagcgacttctacatccccaaggccaccctgaaggactccggctcctacttctgcagaggcctcgtgggcagcaagaacgtgtccagcgagacagtgaacatcaccatcacccagggcctggccgtgtctaccatcagcagctttttcccacccggctaccagacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1260 - DNA, 3072 bp, Artificial Sequence
  Polynucleotide encoding a Synthetic Immune Receptor (SIR)
atggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcgccaccatggccctgcctgtgacagctctgctgctgcctctggcactgctgctgcacgccgccagacctgatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1261 - DNA, 2691 bp, Artificial Sequence
  Polynucleotide encoding a Synthetic Immune Receptor (SIR)
atggccttaccagtgaccgccttgctcctgccgctggccttgctgctccacgccgccaggccggacgaattcgaggtgcagctggtagaatccggcgggggacttgtacaggctggtggtagtctgagactgagctgtgtggcctccggcatcagcagcagcaagcggaacatgggatggtataggcaagcccctggtaagcagagggaatccgtggctacaatcagcagcggcggcaacaaggactacaccgacgccgtgaaggacaggttcaccatctccagggacaccaccaagaacaccgtgtacctgcagatgaactccctcaagcccgaggacaccgccgtgtactactgcaagatcgaggccggcacaggctgggccaccagaagaggctacacatactgggggcagggaacactggtgaccgtgagctccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1262 - DNA, 2733 bp, Artificial Sequence
  Polynucleotide encoding a Synthetic Immune Receptor (SIR)
atggccttaccagtgaccgccttgctcctgccgctggccttgctgctccacgccgccaggccggacgaattcgaggtgcaactggtggaaagcggcggaggactggtgcaggctggcgatagcctgagactgagctgtgccgcctccggcagagccttcagcagatatgccatgggctggttcagacaggcccctggcaaagaacgcgagttcgtggccgccatcggctggggacctagcaagaccaactacgccgacagcgtgaagggccggttcaccatcagccgggacaacgccaagaacaccgtgtacctgcagatgaacaccctgaagcccgaggacaccgccgtgtactcttgcgccgccaagttcgtgaacaccgacagcacctggtcccgcagcgagatgtacacctattggggccagggcaccctcgtgaccgtgtctagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1263 - DNA, 2667 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1264 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1265 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggacagcaccgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacctggccagcaacctgcagagcggcgtgcccagcagattttctggcagcggctccggcaccgacttcaccctgacaatcagctccctgcagcccgaggacttcgccacctactactgtcagcaggccgagtacatgcccctgaccttcggccagggaacaaaggtggaaatcaagagagccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactgctggaatctggcggcggactggtgcagcctggcggatctctgagactgagctgtgccgccagcggcttcacctttagcggctacgccatgagctgggtgcgccaggctcctggcaaaggcctggaatgggtgtccgagatcgcccctcccggcctgaataccagatacgccgatagcgtgaagggccggttcaccatcagccgggacaacagcaagaacaccctgtacctgcagatgaacagcctgcgggccgaggataccgccgtgtactactgcgccaagagcgacaccgccttcgactactggggacagggaacccttgtgaccgtgtccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1266 - DNA, 2661 bp, Artificial Sequence
  Polynucleotide encoding a Synthetic Immune Receptor (SIR)
atggccttaccagtgaccgccttgctcctgccgctggccttgctgctccacgccgccaggccggaccaggccgtgctgacccaggagagcgccctgaccaccagccccggcgagaccgtgaccctgacctgcagaagcagcaccggcgccgtgaccaccagcaactacgccaactgggtgcaggagaagcccgaccacctgttcaccggcctgatcggcggcaccaacaacagagtgcccggcgtgcccgccagattcagcggcagcctgatcggcgacaaggccgccctgaccatcaccggcgcccagaccgaggacgaggccatctacttctgcgtgctgtggcacagcaaccactgggtgttcggcggcggcaccaagctgaccgtgctgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagacgtgcagctggtggagagcggcggcggcctggtgcagcccggcggcagcagaaagctgagctgcgccgccagcggcttcaccttcagcagcttcgggatgcactgggtgagacaggcccccgagaagggcctggagtgggtggcctacatcagcagcggcagcagcaccctgcactacgccgacaccgtgaagggcagattcaccatcagcagagacaaccccaagaacaccctgttcctgcagatgaccagcctgagaagcgaggacaccgccatgtactactgcgccagatggggcaactacccccactacgctatggactactggggccagggcaccagcgtgaccgtgagcagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1267 - DNA, 2727 bp, Artificial Sequence
  Polynucleotide encoding a Synthetic Immune Receptor (SIR)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactggtggaatccgggggaggcagcgtgcaggctgggggatcactgagactgtcttgtgctgcctccggcgacacctacggcagctattggatgggatggtttcggcaggctcccggaaaagaacgggaaggcgtggccgccatcaacagaggcggcggatacaccgtgtacgccgactctgtgaagggcagattcacaatctccagagacacagccaagaatactgtgtacctgcagatgaactccctgcgccccgacgataccgccgactattattgcgccgcttccggcgtgctgggcggcctgcatgaggactggttcaattattggggacagggaacacttgtgacagtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1268 - DNA, 2718 bp, Artificial Sequence
  Polynucleotide encoding a Synthetic Immune Receptor (SIR)
atggccctgcccgtgacagccctgctgctgcctctggctctgctgctgcacgccgccagacccgatgaattcgaggtgcagctcgtagaatctggaggtggttccgtgcaagccggaggatcattgcgactgacctgcgcagcgagcggatctacttctcgctcttacggtatgggatggttcagacaggctcctgggaaagagcgcgagttcgtttcaggcatctcctggaggggggacagcaccggctacgcagatagcgtgaagggcaggttcacgatcagccgagacaacgccaaaaacaccgtcgatctgcaaatgaatagtctgaagcccgaagatactgcgatctactactgtgccgccgcagcagggtccacctggtacggcacactctacgagtacgactactgggggcagggaaccctggtaaccgtgtcctctctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcagctcgtggaaagcggtggcggaagtgtgcaggccggaggcagtttgcgcctgagctgcgctgcttccggcgatacatacgggtcttactggatgggctggtttaggcaggcacctggacaagaaagagaagctgtggccgctattaacaggggaggtggctataccgtttatgctgattccgtgaagggccgattcacaatctcccgggataacgccaaaaacactctgtacctgcagatgaactcccttaggcccgatgacacagccgattactattgtgcggcctccggcgtgctgggtggtctgcatgaggattggttcaactactgggggcaaggcaccctcgtaaccgtgagtagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1269 - DNA, 2634 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1270 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1271 - DNA, 2673 bp, Artificial Sequence
  Polynucleotide encoding a Synthetic Immune Receptor (SIR)
atggccttaccagtgaccgccttgctcctgccgctggccttgctgctccacgccgccaggccggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1272 - DNA, 2676 bp, Artificial Sequence
  Polynucleotide encoding a Synthetic Immune Receptor (SIR)
atggccttaccagtgaccgccttgctcctgccgctggccttgctgctccacgccgccaggccggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1273 - DNA, 2667 bp, Artificial Sequence
  Polynucleotide encoding a Synthetic Immune Receptor (SIR)
atggccttaccagtgaccgccttgctcctgccgctggccttgctgctccacgccgccaggccggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1274 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1275 - DNA, 2664 bp, Artificial Sequence
  Polynucleotide encoding a Synthetic Immune Receptor (SIR)
atggccttaccagtgaccgccttgctcctgccgctggccttgctgctccacgccgccaggccggacatccagatgacacagagccctagcagcctgtctgccagcgtgggagacagagtgaccatcacctgtagaaccagccagagcctgagcagctacacccactggtatcagcagaagcctggcaaggcccctaagctgctgatctatgccgcttccagcagaggcagcggagtgcctagcagattttctggcagcggctccggcaccgatttcaccctgacaatatccagcctccagcctgaggacttcgccacctactactgccagcagagcagaacattcggccagggcaccaaggtggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctccagcagtctggccctggcctggttaagcctagccagacactgagcctgacctgtgccatcagcggcgatagcgtgtccagctacaacgccgtgtggaactggatcagacagagcccatccagaggactggaatggctgggcagaacctactacagaagcggctggtacaacgactacgccgagagcgtgaagtcccggatcaccatcaatcccgacaccagcaagaaccagttcagcctgcaactgaacagcgtgacccctgaggataccgccgtgtactactgtgctagaagcggccacatcaccgtgttcggcgtgaacgtggacgccttcgatatgtggggccagggaacaatggtcaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1276 - DNA, 2661 bp, Artificial Sequence
  Polynucleotide encoding a Synthetic Immune Receptor (SIR)
atggccttaccagtgaccgccttgctcctgccgctggccttgctgctccacgccgccaggccggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1277 - DNA, 2580 bp, Artificial Sequence
  Polynucleotide encoding a Synthetic Immune Receptor (SIR)
atggccttaccagtgaccgccttgctcctgccgctggccttgctgctccacgccgccaggccgaacagctgcgagctgaccaacatcacaatcgccatcgagaaagaggaatgccggttctgcatcagcatcaacaccacttggtgcgccggctactgctacacccgcgatctggtgtataaggaccccgccagacctaagatccagaaaacctgcaccttcaaagagctggtctacgagacagtcagagtgcctggatgtgcccaccacgccgatagcctgtacacataccctgtggctacccagtgccactgcggcaagtgtgatagcgacagcaccgattgcaccgtcagaggactgggacccagctactgtagcttcggcgagatgaaggaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1278 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1279 - DNA, 2646 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1280 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1281 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1282 - DNA, 2673 bp, Artificial Sequence
  Polynucleotide encoding a Synthetic Immune Receptor (SIR)
atggccttaccagtgaccgccttgctcctgccgctggccttgctgctccacgccgccaggccgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1283 - DNA, 2655 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1284 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1285 - DNA, 2643 bp, Artificial Sequence
  Polynucleotide encoding a Synthetic Immune Receptor (SIR)
atggccttaccagtgaccgccttgctcctgccgctggccttgctgctccacgccgccaggccgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1286 - DNA, 2649 bp, Artificial Sequence
  Polynucleotide encoding a Synthetic Immune Receptor (SIR)
atggccttaccagtgaccgccttgctcctgccgctggccttgctgctccacgccgccaggccgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1287 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggacaacatcgagctgacccagagccccgccatcatgagtgcctctccaggcgagcgcgtgaccatgacatgtagcgccagcagcagcatccggtacatctactggtatcagcagaagcccggcagcagccccagactgctgatctacgacaccagcaacgtggcccctggcgtgccctttagattttccggcagcggctccggcaccagctacagcctgaccatcaaccggatggaagccgaggacgccgccacctactattgtcaggaatggagcggctacccctacaccttcggcggaggcaccaagctggacatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctccaggaatctggcggcggactcgtgaagcctggcggctctctgaagctgagctgtgccgccagcggcttcaccttcagcagctacggcatgagctgggtgcgccagacccccgacaagagactggaatgggtggcaaccatcagcagcggcggcagctacacctactaccccgatagcgtgaagggccggttcaccatctccagagacaacgccaagaacaccctgtacctccagatgagcagcctgaagtccgaggataccgccatgtactactgcgccagaggcaactgggagggctggtacttcgatgtgtggggccagggcaccaccgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1288 - DNA, 2682 bp, Artificial Sequence
  Polynucleotide encoding a Synthetic Immune Receptor (SIR)
atggccttaccagtgaccgccttgctcctgccgctggccttgctgctccacgccgccaggccggacaacttcatgctgacccagccccacagcgtgtccgagagccctggcaagaccgtgaccatctcctgtaccggcagcggcggcagcatcgacaacaactacgtgcactggtatcagcagaggcccggcagcgcccctaccaccgtgatgttcgaggacaaccagaggcccagcggcgtgcccgatagattcagcggctctatcgacagcagcagcaacagcgccagcctcgtgatctccggcctgaaaaccgaggacgagggcgactactactgccagagcagcgacggctccaaggtggtgtttggcggaggcaccaagctgaccgtgctgggacagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtgcagagcggcggaggctctctgacactgtcttgtgctgcctccggcgtggtgcagcctggcagattcaccttcagcagctacggaatgcactgggtgcgccaggcccctggaaagggactggaatgggtgtccgtgatctcttacgacggcagcaacaagtattacgccgacagcgtgaagggccggttcaccatctccagagacaacagcaagaacaccctgtacctccagatgaacagcctgcggaccgaggacaccgccgtgtactactgtgccaagaccctgtccgctggcgagtggattggaggcggagccttcgatatctggggccacggcacaatggtcaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1289 - DNA, 2640 bp, Artificial Sequence
  Polynucleotide encoding a Synthetic Immune Receptor (SIR)
atggccttaccagtgaccgccttgctcctgccgctggccttgctgctccacgccgccaggccggacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1290 - DNA, 2649 bp, Artificial Sequence
  Polynucleotide encoding a Synthetic Immune Receptor (SIR)
atggccttaccagtgaccgccttgctcctgccgctggccttgctgctccacgccgccaggccggacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1291 - DNA, 2655 bp, Artificial Sequence
  Polynucleotide encoding a Synthetic Immune Receptor (SIR)
atggccttaccagtgaccgccttgctcctgccgctggccttgctgctccacgccgccaggccggacgacatcgtgctgacccagagccccgccagcctggccgtgagcctgggccagagcgtgaccatcagctgcagagccagcgagagcgtggagtactacggcaccagcctgatgcagtggtaccagcagaagcccggccagccccccaagctgctgatctacgccaccagcaacgtggagagcggcgtgcccgccagattcagcggcagcggcagcggcaccgacttcagcctgaacatccaccccgtggaggaggacgacatcgccatgtacttctgccagcagagcagaaagctgcccagcaccttcggcggcggcaccaagctggagatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagacgtgagactgcaggagagcggccccggccaggtgaagcccagccagaccgtgagcctgacctgcagcgtgaccggctacagcatcaccaacggcaaccactggtggaactggatcagacaggtgagcggcagcaagctggagtggatcggctacatcagcagcagcggcagcaccgacagcaaccccagcctgaagagcagaatcagcatcaccagagacaccagcaagaaccagctgttcctgcagctgaacagcgtgaccaccgaggacatcgccacctactactgcgccagaggctactacttcgactactggggccagggcaccaccctgaccgtgagcagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1292 - DNA, 2730 bp, Artificial Sequence
  Polynucleotide encoding a Synthetic Immune Receptor (SIR)
atggccctgcccgtgacagccctgctgctgcctctggctctgctgctgcacgccgccagacccgatgaattcggctctgacctgggcatcaagctgctgttcgccgctgccaagggccaggacgacgaagtgcggattctgctggctgctggggccgacgtgaacgccaaggatttcgagggctacacccccctgcacgtggccgcctatgatggacacctggaaatcgtggaagtgctgctgaaggctggcgctgatgtgaatgccaaagacagccagggccggacccctctgcatgaagccgcctacagcggccatctggaaattgtggaagtgctgctgaaagccggggcagacgtgaacgctcaggacgacgctggcgagacaccagccgatctggctgcagcttggggccacgaagatatcgccgaggtgctgcagaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcccattccttcgaaagaagcgatctgggaaagaagctgctggaagctgccagagccggacaggatgatgaagtgcgcatcctgatggcaaacggcgcagatgtgaacgcaaaggacgagtacggcctgacccccctgtacctggctacagcccacgggcacctggaaattgtggaagtgctgctgaagaacggcgctgacgtgaacgccgtggacgccatcggctttaccccactgcatctggccgctttcatcgggcatctcgaaatcgcagaggtgctgctgaaacacggggccgatgtgaatgcccaggacaagttcggcaagaccgccttcgacatcagcatcggcaacggcaacgaggacctggccgagatcctgcagaaactgaacacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1293 - DNA, 2688 bp, Artificial Sequence
  Polynucleotide encoding a Synthetic Immune Receptor (SIR)
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtggaatctgggggcggactggtgcagccaggcggaagtctgaggctgtcttgtgccgcctccggcagcatcttcggcttcaacgacatggcctggtatcggcaggctcccggaaaacagcgcgagctggtggctctgattagcagagtgggcgtgaccagcagcgccgactctgtgaagggcagattcacaatctccagagtgaacgccaaggatacagtgtacctccagatgaactctctgaaacctgaggatacagcagtgtactattgctacatggaccagcggctggacggcagcacactggcctactggggacagggaactcaagtgacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1294 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagagccagccaggacgtgaacaccgccgtggcctggtatcagcagaagcctggcaaggcccccaagctgctgatctacagcgccagcttcctggaaagcggcgtgcccagcagattcagcggaagcagaagcggcaccgacttcaccctgaccatcagctccctccagcccgaggacttcgccacctactactgccagcagcactacaccacccctcccaccttcggccagaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatctggcggcggactggtgcagcctggcggatctctgagactgagctgtgccgccagcggcttcaacatcaaggacacctacatccactgggtgcgccaggcccctggaaagggactggaatgggtggcccggatctaccccaccaacggctacaccagatacgccgacagcgtgaagggccggttcaccatcagcgccgacaccagcaagaataccgcctacctccagatgaacagcctgcgggccgaggataccgccgtgtactactgctcaagatggggaggcgacggcttctacgctatggacgtgtggggccagggcacccttgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1295 - DNA, 2703 bp, Artificial Sequence
  Polynucleotide encoding a Synthetic Immune Receptor (SIR)
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtggaatctggaggctctctggtgcagccagggggaagcctgagactgtcttgtgccgcttccggcttcaccttcgacgactacgccatgagctgggtgcgccaggtgccaggcaaaggcctggaatgggtgtccagcatcaactggagcggcacccacaccgattacgccgactccgtgaaaggcagattcacaatcagcagaaacaacgccaacaataccctgtacctgcagatgaactccctgaagtctgaggatacagcagtgtattattgcgccaagaactggcgggacgccggcaccacttggtttgagaaaagcggctctgccggacagggaacccaagtgacagtgtcctccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1296 - DNA, 2649 bp, Artificial Sequence
  Polynucleotide encoding a Synthetic Immune Receptor (SIR)
atggccttaccagtgaccgccttgctcctgccgctggccttgctgctccacgccgccaggccggaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1297 - DNA, 2664 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggacccacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1298 - DNA, 2682 bp, Artificial Sequence
  Polynucleotide encoding a Synthetic Immune Receptor (SIR)
atggccttaccagtgaccgccttgctcctgccgctggccttgctgctccacgccgccaggccgcagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1299 - DNA, 2637 bp, Artificial Sequence
  Polynucleotide encoding a Synthetic Immune Receptor (SIR)
atggccttaccagtgaccgccttgctcctgccgctggccttgctgctccacgccgccaggccggagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagactcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1300 - DNA, 2667 bp, Artificial Sequence
  Polynucleotide encoding a Synthetic Immune Receptor (SIR)
atggccttaccagtgaccgccttgctcctgccgctggccttgctgctccacgccgccaggccggagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctcaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1301 - DNA, 2664 bp, Artificial Sequence
  Polynucleotide encoding a Synthetic Immune Receptor (SIR)
atggccttaccagtgaccgccttgctcctgccgctggccttgctgctccacgccgccaggccggacgacatcgtgatgacccagagccaggacagcatggctaccagcgtgggcgagcgcgtgaccgtgaattgcaaggccagccagaacgtggacaccaacgtggcctggtatcagcagaagcccggccagtctcctgagcccctgctgttcagcgccagctacagatacaccggcgtgcccgacagattcagcggcagcggctctggcaccgacttcaccctgacaatcagcagcgtgcaggccgaggacgtggccgagtatttctgccagcagtacaacagctaccccctgaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaggtggaagtgtctggcggcggactggtgcagcctggcggatctatgagactgagctgtgccgtgtccggcttcaccttcagcaactactggatgaactgggtgcgccagtcccccgagaagggcctggaatggatcgccgagatccggctgaagtccaacaacttcgcccggtactacgccgagagcgtgaagggcagattcaccatcagccgggacaacagcaagaacagcctgtacctccagatgatctccctgagagccgaggacaccgccatctactactgcaccagctacggcaactacgtgggccactacttcgaccactggggccagggaacactgctgaccgtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1302 - DNA, 2685 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcaacggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagaccccccggacctttggacagggcaccaaggtggaaatcaagcggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagtctggcggcggagtggtgcagcctggaagaagcctgagactgagctgtgccgccagcggcttcaccttcagcagctacggaatgcactgggtgcgccaggcccctggcaaaggactggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgcgccagagacttcgactacggcgacagctactactactatggcatggacgtgtggggccagggcacaaccgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1303 - DNA, 2667 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgggcagctacctggcctggtatcagcagaagcctggcgctccccggctgctgatctacgatgcctctcacagagccaccggcatccccgccagattttctggcagcggctccggcaccgacttcaccctgacaatcagctccctggaacccgaggacttcgccgtgtactactgccagcagcggagcaactggccccccatgtataccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtgcagtctggcgctgaggtgtccgtgaaggtgtcctgcaaagccagcggcggcaagaagcccggcagcacctttagcagctacaccatcagctgggtgcgccaggcacctggacagggcctggaatggatgggcggcatcatccccatcttcggcaccgccaactacgcccagaaattccagggcagagtgaccatcaccgccgacaagagcaccagcaccgcctacatggaactgagcagcctgcggagcgaggacacagccgtgtattattgtgccggcgacaccgacagcagcggctactatggcgctgtggactattggggccagggaaccctcgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1304 - DNA, 2616 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1305 - DNA, 3054 bp, Artificial Sequence
  Polynucleotide encoding a Synthetic Immune Receptor (SIR)
atggactggatttggcgcatccttttccttgtcggcgctgctaccggcgcccattccgaggttcagttggtcgaatcaggcgggggcctcgtccaacccggcggaagcctgcggctgtcttgcgcagcaagtggtagtgtgttcaagatcaacgttatggcctggtatcgccaggctccgggaaaagggagagagctggttgcggggatcattagcggtggctccaccagctacgctgacagtgtgaagggaaggttcactatatcacgcgacaacgcaaagaatacattgtacctccagatgaatagcttgcggcccgaagacacggcagtctactattgtgcctttatcacaacagagagcgactatgacctgggccgccggtattgggggcagggaacccttgtgaccgtttcatccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1306 - DNA, 2646 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1307 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1308 - DNA, 2676 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagagccccagcagcctgaccatgagcgtgggccagaaagtgaccatgtcctgcaagagcagccacagcctgctgaacagccggaaccagaagaactacctggcctggttccagcagaagcccggccagtcccccaagctgctggtgtacttcgcaagcacccgcgagagcggcgtgcccgacagattcatcggcagcggctccggcaccgacttcaccctgaccatcagcaacgtgcaggccgaggacctggccgactacttctgccagcagcactacaccaccctgcccaccttcggcggaggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagagcggccctgacctgaagaaacccggcgagacagtgaagatcagttgcaaggcctccggctacaccttcaccaacacaggcatgaactgggtcaagcaggcccctggcaagggcctgaagtggatgggctggatcaacacctacaccggcgagcccacctacgccgacgacttcaagggccggttcaccttcagcctggaaaccagcgccagcaccgcctacctgcagatcaacaacctgaagaacgaggacaccgccacctatttctgcaccagatggggctacggcagcagcctgtactacgccatggactactggggccagggcaccagcgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1309 - DNA, 2646 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1310 - DNA, 2649 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1311 - DNA, 2664 bp, Artificial Sequence
  Polynucleotide encoding a Synthetic Immune Receptor (SIR)
atggccttaccagtgaccgccttgctcctgccgctggccttgctgctccacgccgccaggccggacgacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1312 - DNA, 2646 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1313 - DNA, 2607 bp, Artificial Sequence
  Polynucleotide encoding a Synthetic Immune Receptor (SIR)
atggaaatgctccagggcctgctgctgctcctgctgctttctatgggcggagcttgggccagcagagagcctcttagaccttggtgtcaccccatcaacgccatcctggccgtggaaaaagagggctgccctgtctgcatcaccgtgaacaccacaatctgcgccggctactgccccaccatgatgagagtgctgcaagccgttctgcctcctctgcctcaggtcgtgtgcacctatcgggacgtccgcttcgagagcatcagactgcctggatgtcctagaggcgtggaccccgtggtgtcttttcctgtggctctgtcctgtagatgcggcccctgtagaagaagcaccagcgattgcggcggacccaaggatcaccctctgacatgcgatcacccacagctgagcggcctgttgtttcttctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1314 - DNA, 2649 bp, Artificial Sequence
  Polynucleotide encoding a Synthetic Immune Receptor (SIR)
atggccttaccagtgaccgccttgctcctgccgctggccttgctgctccacgccgccaggccggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1315 - DNA, 2673 bp, Artificial Sequence
  Polynucleotide encoding a Synthetic Immune Receptor (SIR)
atggccttaccagtgaccgccttgctcctgccgctggccttgctgctccacgccgccaggccggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1316 - DNA, 2661 bp, Artificial Sequence
  Polynucleotide encoding a Synthetic Immune Receptor (SIR)
atggccttaccagtgaccgccttgctcctgccgctggccttgctgctccacgccgccaggccggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1317 - DNA, 2679 bp, Artificial Sequence
  Polynucleotide encoding a Synthetic Immune Receptor (SIR)
atggccttaccagtgaccgccttgctcctgccgctggccttgctgctccacgccgccaggccggaccagagcgtgctgacacagcctccatccgtgtctggcgctccaggccagagagtgaccatctcctgtaccggcagcagcagcaacatcggagccggctatgacgtgcactggtatcagcaactgcccggcaccgcccccaagctgctgatctacggcaacagcaacagacccagcggcgtgcccgatagattcagcggcagcaagagcggcacaagcgccagcctggctatcactggactccaggccgaggacgaggccgactactactgccagagctacgacaacagcctgtcctcctgggtgttcggcggaggcaccaagctgacagtgctgggccagcctaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggagccgaagtgaagaaacccggcagctccgtgaaggtgtcctgcaaggcttccggcggcaccttcagcagctacgccatttcttgggtgcgccaggcccctggacagggcctggaatggatgggcagaatcatccccatcctgggaatcgccaactacgcccagaaattccagggccgcgtgaccatcaccgccgacaagagcacaagcaccgcctacatggaactgagcagcctgcggagcgaggacaccgccgtgtactactgcgccagagatgtgggcagcggctcctacagcctggactattggggccagggcaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1318 - DNA, 2670 bp, Artificial Sequence
  Polynucleotide encoding a Synthetic Immune Receptor (SIR)
atggccttaccagtgaccgccttgctcctgccgctggccttgctgctccacgccgccaggccggaccagagcgtcgtgacacagcctccatctgtgtctgccgcccctggccggaaagtgaccatctcttgtagcggcagcagcagcaacatcggcagcaactacgtgtcctggtatcagcaggtgcccggcaccgcccctaagctgctgatctacgaggacgacaagcggcccagcggcatccccgatagattcagcggctctaagagcggcaccagcgccacactgggcatcaccggactccagacaggcgacgaggccgactacttctgcgccacctgggacagaaccgtgaacgtggtgcgctttggcggcggaaccagactgacagtgcacagccagcctaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaactccaactccaggaaagcggccctggcctcgtgaagcctagcgagacactgagcctgacctgcaccgtgtctggcggcagcatctccagcagctcctactactggggctggatcagacagccccctggcaagggcctggaatggatcggctccatctactacagcggaagcacctactacaaccccagcctgaagtcccgcgtgaccatcagcgtggacaccagcaagaaccagttctccctgaagctgagcagcgtgacagccgccgataccgccgtgtactactgtgccagacatgtgggccacgagctggattactggggccagggcacactcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1319 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgatatctggggccagggcacaatggtcaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1320 - DNA, 2727 bp, Artificial Sequence
  Polynucleotide encoding a Synthetic Immune Receptor (SIR)
atggccctgcccgtgacagccctgctgctgcctctggctctgctgctgcacgccgccagacccgatgaattcgatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtggagtccggcggtggactggtacagcctgggggttcactgcgcctgtcctgcgccgccagcggaagaacctattacctcaatgctatgggttggttccgccaggccccaggaaaggagcgcgagttcgtggcggctattgactggtccgaggggaacaaggactatgctgattccgtgaagggcaggtttaccatcagccgggataattcaaaaaatactgtttatttgcagatgaactctcttagaccagaagacactgctgtctattactgcgccgctgacacccctccttggggaccactgatttatatcgaaagctatgattcctgggggcagggcacactcgtcaccgtgagtagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1321 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1322 - DNA, 2649 bp, Artificial Sequence
  Polynucleotide encoding a Synthetic Immune Receptor (SIR)
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1323 - DNA, 2649 bp, Artificial Sequence
  Polynucleotide encoding a Synthetic Immune Receptor (SIR)
atggccctgcctgtgacagctctgctgctgcctctggcactgctgctgcacgccgccagacctgacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1324 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggacatcgtaatgacccaggctgccccatccataccagtcactcccggtgaatccgtgtctatatcttgtaggtccgataagagtctgcttcacagcaacggcaatacttatcttttctggtttttgcagcgaccgggacaaagcccacaactgctgatctatagaatgtcaaatcttgcatcaggggtcccagatcgctttagtggatctgggtcaggcacagctttcaccctgagaatctccggagtggaagcagaagacgtaggcgtgtattactgtatgcagcaccttgagtatccttatacctttggaggcggaactaagctcgaaattaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcaactgcagcagtctggacctgaactggtgaagcctggggcctcagtgaagatgtcctgcaaggcttctggctacgcattcagtagttcctggttgaactgggtgaggcagaggcctggaaagggtcttgagtggattggacggatttatcctggagatggagaaaatcactataatgggaaattcaagggcaaggccacactgactgcagacaaatcctccagcacaggctacatgcaactcagcagcctgacgtctgaggactctgcggtctacttctgtgcaagttattatgaagggggttattggggccaagggactctaatcactgtctctgcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1325 - DNA, 2649 bp, Artificial Sequence
  Polynucleotide encoding a Synthetic Immune Receptor (SIR)
atggccttaccagtgaccgccttgctcctgccgctggccttgctgctccacgccgccaggccggacatcgtactgacacagagccccgcttctctggcagtgtcactgggccagtccgttacaatatcctgtcgggcgagtgaatccgtggaatactatggaacaagtctcatgcagtggtatcagcagaaacctggacagccccccaagctgctcatctacggtgcgtcaaatgtcgagagtggggttccggcccgattcagtggttccgggagtggcacagactttagcctcaacatccatcctgttgaggaagacgatattgccatgtatttttgccaacagtcccgcaaagtcccctggacctttggtggaggaactaagctggagatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtcaagctggtagagagtggaggtgggctggttaaaccaggggggagcagaaaactgagttgtgccgcaagtggcttcaccttttctagctataccatgagctgggtaagacaaactccagcaaagcgccttgagtgggtcgcaacaattagcagcggatcttctactatttattacgctgacactgttaagggccggtttaccatatcaagagacaacgccaagaatacccttttccttcaaatgacttcactgcggtccgaggatacggcaatgtactattgtgcacgacggtggtttctcgactgctggggccaggggactacccttaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1326 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccggaccaggtgcagctgcagcagtcgggcccaggactggtgaagccttcggagaccctgtccctcacctgcactgtctctggtgactccatcagtagttactactggagctggatcaggcagcccccagggaagggactggagtggattgggtatatctattacagtgggagcaccaactacaacccctccctcaagagtcgagtcaccatatcagtagacacgtccaagagccagttctccctgaagctgagctctgtgaccgccgcagacacggccgtgtattactgtgcgcgcggcaggtacttcgatgtctggggacgaggcactatggtgactagcagcctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatcctcctacgtgctgactcagcctccctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcacccgagttttcggcggagggaccaagctgaccgtcctaggtgccgccgcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1327 - DNA, 2661 bp, Artificial Sequence
  Polynucleotide encoding a Synthetic Immune Receptor (SIR)
atggccttaccagtgaccgccttgctcctgccgctggccttgctgctccacgccgccaggccggacatcgtaatgacacagtctcccctgtccctccctgtcacaccaggtgaacctgccagtatttcttgtagatccagtaagtcacttctgcactccaatgggaacacctacctgtattggttccagcaaaagcctggtcaggcacctcgcttgcttatttataggatgtccaatcttgcatccggcgtgccagaccgattctcaggctccggctctggtactgcatttaccctgaaaatctcccgcgtggaagcagaagatgtgggcgtgtactactgtatgcagcacatcgagtaccccttcacgtttggtcaaggcacaaagctggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccagctcgtccagtctggacccgaagtcaagaagccaggcgcctctgtgaaggtttcttgtaaggccagcggatatacattcactaattcatggatgaactgggtgaggcagcgccctggcaaggggcttgagtggatcgggcggatttacccaggggatggcgagacaatttacaacgggaaatttcgggtgagagtgacgatcaccgcagacgaatctacaagcacggcctacatggagttgtcctctctcaggagtgaggacaccgccgtctactattgtgctagaggttatgacgactattcattcgcatactggggccagggcaccaccgtcacagtatcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1328 - DNA, 2661 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1329 - DNA, 2670 bp, Artificial Sequence
  Polynucleotide encoding a Synthetic Immune Receptor (SIR)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1330 - DNA, 2676 bp, Artificial Sequence
  Polynucleotide encoding a Synthetic Immune Receptor (SIR)
atggccttaccagtgaccgccttgctcctgccgctggccttgctgctccacgccgccaggccggacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1331 - DNA, 2676 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagtacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1332 - DNA, 2841 bp, Artificial Sequence
  Polynucleotide encoding a Synthetic Immune Receptor (SIR)
atggccttaccagtgaccgccttgctcctgccgctggccttgctgctccacgccgccaggccgctgttcaaccaggaagtgcagatccccctgaccgagagctactgcggcccctgccccaagaactggatctgctacaagaacaactgctaccagttcttcgacgagagcaagaattggtacgagagccaggcttcctgcatgagccagaacgccagcctgctgaaggtgtacagcaaagaggaccaggatctgctgaagctggtcaagagctaccactggatgggcctggtgcacatccccaccaacggctcttggcagtgggaggacggcagcatcctgagccccaacctgctgaccatcatcgagatgcagaagggcgactgcgccctgtacgccagcagcttcaagggctacatcgagaactgctccacccccaacacctacatctgtatgcagcggaccgtgggcggaggcggaagtggaggcggaggagacctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactgttcaaccaggaggtccaaataccactgacggagagttactgcgggccatgtccgaaaaattggatctgctataaaaacaactgctatcagtttttcgacgagagtaagaactggtacgaaagccaggcgagctgcatgtcccaaaatgcttccttgttgaaagtttactccaaagaggatcaagacctgctgaagctggtcaaatcttaccactggatgggtcttgttcacatccccactaacggttcctggcaatgggaagatggatctatacttagccctaacttgttgacgataattgaaatgcagaaaggcgactgtgcactttacgcttcctctttcaaaggctacattgagaattgttcaactccgaatacatatatctgtatgcagaggaccgttggcggtggagggagcggaggaggaggtgacacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1333 - DNA, 2643 bp, Artificial Sequence
  Polynucleotide encoding a Synthetic Immune Receptor (SIR)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1334 - DNA, 2649 bp, Artificial Sequence
  Polynucleotide encoding a Synthetic Immune Receptor (SIR)
atggccttaccagtgaccgccttgctcctgccgctggccttgctgctccacgccgccaggccggacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1335 - DNA, 2655 bp, Artificial Sequence
  Polynucleotide encoding a Synthetic Immune Receptor (SIR)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcagctgctggaatctggcggcggactggtgcagcctggcggatctctgagactgagctgtgccgcctccggcttcaccttcagcacctaccagatgagctgggtgcgccaggcccctggcaaaggactggaatgggtgtccgggatcgtgtccagcggcggctctacagcctacgccgatagcgtgaagggccggttcaccatcagccgggacaacagcaagaacaccctgtacctgcagatgaacagcctgagagccgaggacaccgccgtgtactattgtgccggcgagctgctgccctactacggcatggatgtgtggggccagggcaccaccgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1336 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctgctggaatctggcggcggactggtgcagcctggcggatctctgagactgagctgtgccgccagcggcttcaccttcagcacctacgagatgcactgggtgcgccaggcccctggcaaaggactggaatgggtgtccgtgatcctgagcagcggcggagagacaaactacgccgacagcgtgaagggccggttcaccatcagccgggacaacagcaagaacaccctgtacctccagatgaacagcctgcgggccgaggacaccgccgtgtactattgtgccggaatgctgctgccctactacggcatggatgtgtggggccagggcaccaccgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1337 - DNA, 2847 bp, Artificial Sequence
  Polynucleotide encoding a Synthetic Immune Receptor (SIR)
atgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggctggtttctggacagccctgacagaccctggaatcctccaacattcagccccgctctgctggtggttaccgagggcgataatgccaccttcacctgtagcttcagcaacaccagcgagagcttcgtgctgaactggtacagaatgagccccagcaaccagaccgacaagctggccgcctttcctgaggatagaagccagcctggacaggactgccggttcagagttacccagctgcctaacggcagagacttccacatgagcgttgtgcgggccagaagaaacgacagcggcacatatctgtgcggagccatctctctggcccctaaggctcagatcaaagagagcctgagagccgagctgagagtgacagaaagacgggccgaagtgcccacagctcacccttcaccttctccaagacctgccggccagttccagacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1338 - DNA, 2646 bp, Artificial Sequence
  Polynucleotide encoding a Synthetic Immune Receptor (SIR)
atggccttaccagtgaccgccttgctcctgccgctggccttgctgctccacgccgccaggccggacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1339 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1340 - DNA, 2646 bp, Artificial Sequence
  Polynucleotide encoding a Synthetic Immune Receptor (SIR)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1341 - DNA, 2703 bp, Artificial Sequence
  Polynucleotide encoding a Synthetic Immune Receptor (SIR)
atggccttaccagtgaccgccttgctcctgccgctggccttgctgctccacgccgccaggccggacgacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1342 - DNA, 2694 bp, Artificial Sequence
  Polynucleotide encoding a Synthetic Immune Receptor (SIR)
atggccttaccagtgaccgccttgctcctgccgctggccttgctgctccacgccgccaggccggaccagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1343 - DNA, 2616 bp, Artificial Sequence
  Polynucleotide encoding a Synthetic Immune Receptor (SIR)
atggccttaccagtgaccgccttgctcctgccgctggccttgctgctccacgccgccaggccggacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1344 - DNA, 2664 bp, Artificial Sequence
  Polynucleotide encoding a Synthetic Immune Receptor (SIR)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1345 - DNA, 2637 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1346 - DNA, 2643 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1347 - DNA, 2643 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1348 - DNA, 2649 bp, Artificial Sequence
  Polynucleotide encoding a Synthetic Immune Receptor (SIR)
atggccttaccagtgaccgccttgctcctgccgctggccttgctgctccacgccgccaggccggacatcaagatgacccagagccccagctctatgtacgccagcctgggcgagcgcgtgaccatcacctgtaaagccagccccgacatcaacagctacctgagctggttccagcagaagcccggcaagagccccaagaccctgatctaccgggccaacagactggtggatggcgtgcccagcagattctctggcggcggaagcggccaggactacagcctgaccatcaactccctggaatacgaggacatgggcatctactactgcctccagtacgacgagttcccctacaccttcggcggaggcaccaagctggaaatgaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgaagctggtggaatcaggaggaggcctcgtgaaacctggcggctctctgaagctgagctgtgccgccagcggcttcaccttcagcagctacgccatgagctgggtgcgccagattcccgagaagcggctggaatgggtggcctccattagcagaggcggcaccacctactaccccgacagcgtgaagggccggttcaccatctccagagacaacgtgcggaacatcctgtacctccagatgagcagcctgcggagcgaggacaccgccatgtactactgcggcagatacgactacgacggctactacgctatggactactggggccagggcaccagcgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1349 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccggacgacgtggtcgtgacccctgtgtcctgcttcctgagctgcatctctggcgccgagggccaccacctgattcagggccagcagaagtgccagtacatctggctgctgtacgccctggaacccaccgagacaagaaccgccacccagacccctcacctgtcctgcatccagcccagaatctggggaccctgccaggtgcagtggcagtgggtgtgggatagactgcacccccagcaccctagttgtggcggcggaggctgttgcaacctgctgctgtctgcccacggcgcctacacatttggcggaggcacccggctggaactgaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgaagctccaggaaagcggccctgagctcgtgaagcctggcgcctctgtgaagatgagctgcaaggccagcggctacaccttcaccagctacgtgatgcactgggtcaagcagaagcccggccagggcctggaatggatcggctacatcaacccctacaacgacggcaccaagtacaacgagaagttcaagggcaaggccaccctgaccagcgacaagagcagcagcaccgcctacatggaactgagcagcctgacctccgaggacagcgccgtgtactactgcgcccggtggaaaatctactacggcaactacgaggactactggggccagggcacacccctgacagtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1350 - DNA, 2676 bp, Artificial Sequence
  Polynucleotide encoding a Synthetic Immune Receptor (SIR)
atggccttaccagtgaccgccttgctcctgccgctggccttgctgctccacgccgccaggccggacgaattccaggtgcaactggtgcagtctggcggagggctggtgcagccagggggatctctgagactgagctgtgccgccagcgacttcgacttcgccgcctacgagatgagctgggtgcgccaggctcctggacagggactggaatgggtggccatcatcagccacgacggcatcgacaagtattacaccgacagcgtgaagggccggttcaccatcagccgggacaacagcaagaacaccctgtacctgcagatgaataccctgcgggccgaggacaccgccacctactattgcctgagactgggagccgtgggccagggcacacttgtgacagtgtctagcctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggaggcggactggtgcagcctgggggcagtctgaggctgtcttgtgccgcctccgatttcgccttcgatgattacgagatgtcttgggtgcggcaggccccaggcaaagccctggaatggatcggcgacatcaaccacagcggcaccaccatctacaaccccagcctgaagtccagagtgaccatctccagagacaactccaagaatactctgtacctgcagatgaacacactgagagccgaagatacagccatctactactgcgccagaccccactacggcgactacagcgacgccttcgacatctggggccagggaaccatggtcaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1351 - DNA, 2673 bp, Artificial Sequence
  Polynucleotide encoding a Synthetic Immune Receptor (SIR)
atggccttaccagtgaccgccttgctcctgccgctggccttgctgctccacgccgccaggccggagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1352 - DNA, 2661 bp, Artificial Sequence
  Polynucleotide encoding a Synthetic Immune Receptor (SIR)
atggccttaccagtgaccgccttgctcctgccgctggccttgctgctccacgccgccaggccgcagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1353 - DNA, 2646 bp, Artificial Sequence
  Polynucleotide encoding a Synthetic Immune Receptor (SIR)
atggccttaccagtgaccgccttgctcctgccgctggccttgctgctccacgccgccaggccggagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1354 - DNA, 2679 bp, Artificial Sequence
  Polynucleotide encoding a Synthetic Immune Receptor (SIR)
atggccttaccagtgaccgccttgctcctgccgctggccttgctgctccacgccgccaggccggacgtcgtgatgacccagagccctctgagcctgcctgtgacacctggcgagcctgccagcatcagctgtagaagcagccagagcctgctgcacagcaacggccacaactacctggactggtatctccagaagcccggccagagcccccagctgctgatctacctgggcagcaatagagccagcggcgtgcccgatagattcagcggctctggaagcggcaccgacttcaccctgaagatcagccgggtggaagccgaggacgtgggcgtgtactactgtatgcagaccctccagacccccctgacctttggccctggcaccaaggtggacatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtggaaacaggcggaggcgtggtgcagcctggcagaagcctgagactgagctgtgccgccagcggcttcaccttcagcagctacggaatgcactgggtgcgccaggcccctggcaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacaccgccgtgtactattgcgccaaggacagatacggctggggcagcagcttcggccacttcgattattggggccagggcaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1355 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1356 - DNA, 2685 bp, Artificial Sequence
  Polynucleotide encoding a Synthetic Immune Receptor (SIR)
atggccttaccagtgaccgccttgctcctgccgctggccttgctgctccacgccgccaggccggacgacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1357 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1358 - DNA, 2667 bp, Artificial Sequence
  Polynucleotide encoding a Synthetic Immune Receptor (SIR)
atggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1359 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1360 - DNA, 2655 bp, Artificial Sequence
  Polynucleotide encoding a Synthetic Immune Receptor (SIR)
atggccttaccagtgaccgccttgctcctgccgctggccttgctgctccacgccgccaggccggacgacatccagatgacccagagccccagcatcctgagcgccagcgtgggcgacagagtgaccatcacctgtcgggccagccagagattcggcgactacctggcctggtatcagcagaagcctggacaggcccccaagctgctgatctacggcgcttccacactccagagcggcgtgcccagcagattttctggcagcggctccggcaccgagttcaccctgacaatcagcggcctccagcccgaggacttcgccacctactattgccagcaggccaacagcttccctatcaccttcggcaagggcacccggctggacatcagaagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggccgaagtgaagaaacccggcagcagcgtgaaggtgtcctgcaaggcttccggcggcaccttcagcagctacgccatttcttgggtgcgccaggccccaggacagggcctggaatggatgggctggatcaacgtgggcaacggcaacgccatctacagccagaaattccagggccgcgtgacaatcaccagagacaccagcgccaccaccgcctacatggaactgagcagcctgcggagcgaggacaccgccgtgtactactgtgccagggatggcgagagagcctgggacctggattattggggccagggcacactcgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1361 - DNA, 2670 bp, Artificial Sequence
  Polynucleotide encoding a Synthetic Immune Receptor (SIR)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctacacattcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagtctggcggcggagtggtgcagcctggaagaagcctgagactgtcctgtgccgccagcggcttcaccttcagcagctacgccatgcactgggtgcgccaggcccctggaaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacacagccgtgtattattgcgccagagagctgcggttcctggaatggtccagcgacgccttcgacatctggggccagggaacaatggtcaccgtgtcctccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1362 - DNA, 2655 bp, Artificial Sequence
  Polynucleotide encoding a Synthetic Immune Receptor (SIR)
atggccttaccagtgaccgccttgctcctgccgctggccttgctgctccacgccgccaggccggagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1363 - DNA, 2682 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1364 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1365 - DNA, 2643 bp, Artificial Sequence
  Polynucleotide encoding a Synthetic Immune Receptor (SIR)
atggccttaccagtgaccgccttgctcctgccgctggccttgctgctccacgccgccaggccggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1366 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1367 - DNA, 2655 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1368 - DNA, 2661 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1369 - DNA, 2598 bp, Artificial Sequence
  Polynucleotide encoding a Synthetic Immune Receptor (SIR)
atgacagccctgttcctgatgtccatgctgttcggcctggcctgcggacaggccatgtctttctgtatccccaccgagtacaccatgcacatcgagagaagagagtgcgcctactgcctgaccatcaacaccacaatctgcgccggctactgcatgacacgggatattaacggcaagctgttcctgcctaagtacgccctgagccaggacgtgtgcacctaccgggacttcatctaccggaccgtggaaatccctggctgccctctgcatgtggccccttactttagctaccccgtggctctgagctgcaagtgcggcaagtgcaacaccgactacagcgactgtatccacgaggccatcaagaccaactactgcaccaagcctcagaaaagctacctcgtgggcttctctgttctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1370 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1371 - DNA, 2643 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1372 - DNA, 2676 bp, Artificial Sequence
  Polynucleotide encoding a Synthetic Immune Receptor (SIR)
atggccttaccagtgaccgccttgctcctgccgctggccttgctgctccacgccgccaggccggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1373 - DNA, 2661 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1374 - DNA, 2676 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcatcggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccccctgacctttggcggaggcaccaaggtggaaatcaagcggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaaagcggaggcggcgtggtgcagcctggaagaagcctgagactgagctgtgccgccagcggcttcaccttccggtcctacggaatgcactgggtgcgccaggcccctggcaaaggactggaatgggtggccgtgatctcctacgacggctccaacaagtactacaccgacagcgtgaacggcagattcaccatcagcagagacaacagcaagaacaccctgtacctccagatgaacagcctgcgggccgaggacaccgccgtgtactattgtgctagaggcggaggctactacgagacaagcggccctgattactggggccagggcacactcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1375 - DNA, 2670 bp, Artificial Sequence
  Polynucleotide encoding a Synthetic Immune Receptor (SIR)
atggccttaccagtgaccgccttgctcctgccgctggccttgctgctccacgccgccaggccggacgacgtcgtgatgacccagagccctctgagcctgcctgtgacacctggcgagcctgccagcatctcctgtagaagcagccagagcctgctgcacagcatcggctacaactacctgcactggtttctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccctcccacctttggacagggcaccagactggaaatcaagcggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaactccaactccaggaaagcggccctggcctcgtgaagcctagcggcacactgagcctgacatgtgccgtgtctggcggcagcatcagcagcagcaactggtggtcttgggtgcgccagcctcctggcaagggcctggaatggatcggcgaaatctaccacagcggcagcaccaactacaaccccagcctgaagtccagagtgaccatcagcgtggacaagagcaagaaccagttctccctgaagctgagcagcgtgacagccgccgataccgccgtgtactattgcgtgggcagcccctacggcgactacgtgctggattattggggccagggcaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1376 - DNA, 2676 bp, Artificial Sequence; identical to SEQ ID NO: 1374
  Polynucleotide encoding a Synthetic Immune Receptor (SIR)

SEQ ID NO: 1377 - DNA, 2664 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1378 - DNA, 2664 bp, Artificial Sequence
  Polynucleotide encoding a Synthetic Immune Receptor (SIR)
atggccttaccagtgaccgccttgctcctgccgctggccttgctgctccacgccgccaggccggaccagaccgtcgtgacacagcctcctagcgcctctggcacaccaggccagagagtgaccatctcctgtagcggcagcagcagcaacatcggcagcaactacgtgtactggtatcagcaactgcccggcaccgcccccaagctgctgatctacagaagcaaccagcggcccagcggcgtgcccgatagattttctggcagcaagagcggcaccagcgccagcctggctatctctggacctagaagcgtggacgaggccgactactactgcgccgcctgggacgatagcctgaacggcgtggtgtttggcggaggcaccaagctgacagtgctgggtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagtctggggccgaagtgaagaaacccggcagctccgtgaaggtgtcctgcaaggcttccggcggcaccttcagcagctacgccatttcttgggtgcgccaggcccctggacagggcctggaatggatgggcggcatcatccccatctttggcaccgccaactacgcccagaaattccagggccgcgtgaccatcaccgccgacgagtctacaagcaccgcctacatggaactgagcagcctgcggagcgaggataccgccgtgtactactgtgccagaagaatccccccctactacggcatggacgtgtggggccagggaaccaccgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1379 - DNA, 2661 bp, Artificial Sequence
  Polynucleotide encoding a Synthetic Immune Receptor (SIR)
atggccttaccagtgaccgccttgctcctgccgctggccttgctgctccacgccgccaggccggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtgcagtctggcggaggggtcatgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgttaccgtgtcctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1380 - DNA, 2703 bp, Artificial Sequence
  Polynucleotide encoding a Synthetic Immune Receptor (SIR)
atggccttaccagtgaccgccttgctcctgccgctggccttgctgctccacgccgccaggccggaacagaaactcatcagtgaagaagacctggaattccaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1381 - DNA, 2682 bp, Artificial Sequence
  Polynucleotide encoding a Synthetic Immune Receptor (SIR)
atggccttaccagtgaccgccttgctcctgccgctggccttgctgctccacgccgccaggccggaacagaaactcatcagtgaagaagacctggaattcgacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1382 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1383 - DNA, 2655 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1384 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggacgagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1385 - DNA, 2658 bp, Artificial Sequence
  Polynucleotide encoding a Synthetic Immune Receptor (SIR)
atggccttaccagtgaccgccttgctcctgccgctggccttgctgctccacgccgccaggccggacgacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1386 - DNA, 2631 bp, Artificial Sequence
  Polynucleotide encoding a Synthetic Immune Receptor (SIR)
atggccttaccagtgaccgccttgctcctgccgctggccttgctgctccacgccgccaggccggacgacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1387 - DNA, 2640 bp, Artificial Sequence
  Polynucleotide encoding a Synthetic Immune Receptor (SIR)
atggccttaccagtgaccgccttgctcctgccgctggccttgctgctccacgccgccaggccggacgacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1388 - DNA, 2661 bp, Artificial Sequence
  Polynucleotide encoding a Synthetic Immune Receptor (SIR)
atggccttaccagtgaccgccttgctcctgccgctggccttgctgctccacgccgccaggccggacgacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1389 - DNA, 2673 bp, Artificial Sequence
  Polynucleotide encoding a Synthetic Immune Receptor (SIR)
atggccttaccagtgaccgccttgctcctgccgctggccttgctgctccacgccgccaggccggacgacatccagctcacacagagcccttctagcctgtctgccagcgtgggcgacagagtgaccatcacatgtagagccagccagagcgtggactacgacggcgacagctacatgaactggtatcagcagaagcccggcaaggcccctaagctgctgatctacgccgccagctatctggaaagcggcgtgccaagcagattttccggctctggcagcggcaccgatttcaccctgacaatatccagcctccagcctgaggacttcgccacctactactgccagcagagccatgaggacccctacacctttggacagggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttgaatctggcggcggactggttcagcctggcggatctctgagactgagctgtgccgtgtctggctacagcatcaccagcggctactcttggaactggatcagacaggcccctggcaaaggactggaatgggtcgcctccatcacctacgatggcagcaccaactacaaccccagcgtgaagggcagaatcaccatcagcagggacgacagcaagaacaccttctacctgcaaatgaacagcctgagagccgaggacaccgccgtgtactattgtgccagaggcagccactacttcggccactggcattttgctgtgtggggccagggaaccctggtcacagtttcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1390 - DNA, 2649 bp, Artificial Sequence
  Polynucleotide encoding a Synthetic Immune Receptor (SIR)
atggccttaccagtgaccgccttgctcctgccgctggccttgctgctccacgccgccaggccggacgacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1391 - DNA, 2649 bp, Artificial Sequence
  Polynucleotide encoding a Synthetic Immune Receptor (SIR)
atggccttaccagtgaccgccttgctcctgccgctggccttgctgctccacgccgccaggccggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1392 - DNA, 2652 bp, Artificial Sequence
  Polynucleotide encoding a Synthetic Immune Receptor (SIR)
atggccttaccagtgaccgccttgctcctgccgctggccttgctgctccacgccgccaggccggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1393 - DNA, 2574 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacatgcaaggccagcaagaacatcagaagctacctggcctggtatcagcagaagcccggcaaggcccccaagctgctgatctacagcggcagcacactgcacagcggcgtgcccagcagattttccggctctggcagcggcaccgacttcaccctgaccatctctagcctccagcccgaggacttcgccacctactactgccagcagcaccacgagtaccccctgacattcggccagggcaccaaggtggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccaggaatctggccccggactcgtgaagcccagcgagacactgagcctgacctgtaccgtgtccggctacaccatcaccagcggctacgactggtcctggatcagacagcctcctggcaagggcctggaatggatcggctacatcaactacggcggctccaccaactacaagcccagcctgggaagccgcgtgacaatcagcgtggacacctccaagaaccagttcagcctgaagctgagcagcgtgacagccgccgataccgccgtgtactactgcgcccggtacaacgagtacaagagctacatctacgattggtacttcgacttctggggccagggaaccctcgtgaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 1394 - DNA, 2655 bp, Artificial Sequence
  Polynucleotide encoding a Synthetic Immune Receptor (SIR)
atggccttaccagtgaccgccttgctcctgccgctggccttgctgctccacgccgccaggccgcagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagtacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 1395 - DNA, 2673 bp, Artificial Sequence
  Polynucleotide encoding a Synthetic Immune Receptor (SIR)
atggccttaccagtgaccgccttgctcctgccgctggccttgctgctccacgccgccaggccgcagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 1396 - DNA, 2688 bp, Artificial Sequence
  Polynucleotide encoding a Synthetic Immune Receptor (SIR)
atggccttaccagtgaccgccttgctcctgccgctggccttgctgctccacgccgccaggccgcagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 1397 - DNA, 2676 bp, Artificial Sequence
  Polynucleotide encoding a Synthetic Immune Receptor (SIR)
atggccttaccagtgaccgccttgctcctgccgctggccttgctgctccacgccgccaggccgctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagactcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 1398 - DNA, 2643 bp, Artificial Sequence
  Polynucleotide encoding a Synthetic Immune Receptor (SIR)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 1399 - DNA, 2646 bp, Artificial Sequence
  Polynucleotide encoding a Synthetic Immune Receptor (SIR)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 1400-1409 - skipped (10 entries)

SEQ ID NO: 1410 - DNA, 2859 bp, Artificial Sequence; identical to SEQ ID NO: 942
  Polynucleotide encoding a Synthetic Immune Receptor (SIR)

SEQ ID NO: 1411 - DNA, 2862 bp, Artificial Sequence
  Polynucleotide encoding a Synthetic Immune Receptor (SIR)
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1412 - DNA, 2865 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1413 - DNA, 2886 bp, Artificial Sequence
  Polynucleotide encoding a Synthetic Immune Receptor (SIR)
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1414 - DNA, 2883 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccaggccgctcccagcatccctgtgacacctggcgagagcgtgtccatctcctgccggtctagcaagagcctgctgaacagcaacggcaatacctacctgtactggttcctccagcggccaggccagtctccccaactgctgatctaccggatgagcaacctggcctccggcgtgcccgatagattttctggcagcggctccggcaccgccttcaccctgagaatcagcagagtggaagccgaggacgtgggcgtgtactactgtatgcagcacctggaataccccttcaccttcggagccggcaccaagctggaactgaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggccctgagctgattaagcctggggccagcgtgaagatgagctgcaaggccagcggctacaccttcaccagctacgtgatgcactgggtcaagcagaagcccggccagggcctggaatggatcggctacatcaacccctacaacgatggcaccaagtacaacgagaagttcaagggcaaggccaccctgaccagcgacaagagcagcagcaccgcctacatggaactgagcagcctgacaagcgaggacagcgccgtgtactattgcgccagaggcacctactactacggcagccgggtgttcgactattggggccagggcaccacactgaccgtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1415 - DNA, 2859 bp, Artificial Sequence
  Polynucleotide encoding a Synthetic Immune Receptor (SIR)
atggccttaccagtgaccgccttgctcctgccgctggccttgctgctccacgccgccaggccggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1416 - DNA, 2889 bp, Artificial Sequence
  Polynucleotide encoding a Synthetic Immune Receptor (SIR)
atggccttaccagtgaccgccttgctcctgccgctggccttgctgctccacgccgccaggccggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1417 - DNA, 2862 bp, Artificial Sequence
  Polynucleotide encoding a Synthetic Immune Receptor (SIR)
atggccttaccagtgaccgccttgctcctgccgctggccttgctgctccacgccgccaggccggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1418 - DNA, 2883 bp, Artificial Sequence
  Polynucleotide encoding a Synthetic Immune Receptor (SIR)
atgaggctccctgctcagctcctggggctgctaatgctctgggtctctggaagcagtggggatgttgtgatgactcagtctccactctccctgcccgtcacccctggagcgccggcctccatctcctgcagatccagtcagagcattgtacatagtaatggaaacacctatttagagtggtatcttcaaaagccagggcagtctccaaagctcctgatctataaagtttccaaccgattttctggagtccctgacaggttcagtggaagtggatcaggcacagattttacactgagaatcagcagagtggaggctgaggatgttggaatttattactgctttcaaggttcacatgttcctccgacgttcggccctgggaccaaattggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtggagtctgggggaggcttggtccagcctggggggtccctgagactctcctgttcagcctctggattcacctttagtagctttggaatgcactgggtccgccaggctccagggaaggggctggaatgggtggcctacattagtagtggcagtagtaccatctactatggagacaccgtgaagggccgattcaccatctccagagacaacgccaagaactcactgtttctgcaaatgagcagcctgagagccgaggacacggccgtgtattattgtgcgagagaggggggatattactacggaaggagttactatactatggactactggggccaagggaccacggtcaccgtctccacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1419 - DNA, 3825 bp, Artificial Sequence
  Polynucleotide encoding a Synthetic Immune Receptor (SIR)
atggccttaccagtgaccgccttgctcctgccgctggccttgctgctccacgccgccaggccggccagaaagagaacccagcccaccttcggcttcaccgtgaactggaagttcagcgagagcaccaccgtgttcaccggccagtgcttcatcgaccggaacggcaaagaggtgctgaaaaccatgtggctgctgcggagcagcgtgaacgacatcggcgacgactggaaggccaccagagtgggcatcaacatcttcacccggctgcggacacagaaagagggcggctctggcggaagcgccagaaagtgtagcctgaccggcaagtggaccaacgacctgggcagcaacatgaccatcggagccgtgaacagcagaggcgagtttaccggcacctacatcaccgccgtgaccgccaccagcaacgagatcaaagagagccccctgcacggcacccagaacaccatcaacaagagcggcggcagcacaacagtgtttacaggacagtgctttattgaccgcaatgggaaagaagtgctgaaaacaatgtggctgctgaggtcctccgtgaatgacattggagatgattggaaagctacaagagtggggattaacatttttaccagactgaggacccagaaagaagggggcagcggaggctccgccagaaaatgctctctgacagggaagtggacaaatgatctggggtccaatatgacaatcggcgctgtgaactctcggggcgagttcactggaacatatattacagccgtgacagctacctctaacgaaatcaaagagtctcctctgcacgggacacagaataccattaacaaacggacccagcctacatttgggtttacagtgaattggaaattctccgagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagccagaaagagaacccagcccaccttcggcttcaccgtgaactggaagttcagcgagagcaccaccgtgttcaccggccagtgcttcatcgaccggaacggcaaagaggtgctgaaaaccatgtggctgctgcggagcagcgtgaacgacatcggcgacgactggaaggccaccagagtgggcatcaacatcttcacccggctgcggacacagaaagagggcggctctggcggaagcgccagaaagtgtagcctgaccggcaagtggaccaacgacctgggcagcaacatgaccatcggagccgtgaacagcagaggcgagtttaccggcacctacatcaccgccgtgaccgccaccagcaacgagatcaaagagagccccctgcacggcacccagaacaccatcaacaagagcggcggcagcacaacagtgtttacaggacagtgctttattgaccgcaatgggaaagaagtgctgaaaacaatgtggctgctgaggtcctccgtgaatgacattggagatgattggaaagctacaagagtggggattaacatttttaccagactgaggacccagaaagaagggggcagcggaggctccgccagaaaatgctctctgacagggaagtggacaaatgatctggggtccaatatgacaatcggcgctgtgaactctcggggcgagttcactggaacatatattacagccgtgacagctacctctaacgaaatcaaagagtctcctctgcacgggacacagaataccattaacaaacggacccagcctacatttgggtttacagtgaattggaaattctccgagacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1420 - DNA, 2874 bp, Artificial Sequence
  Polynucleotide encoding a Synthetic Immune Receptor (SIR)
atggccttaccagtgaccgccttgctcctgccgctggccttgctgctccacgccgccaggccggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1421 - DNA, 2868 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1422 - DNA, 2868 bp, Artificial Sequence
  Polynucleotide encoding a Synthetic Immune Receptor (SIR)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1423 - DNA, 2871 bp, Artificial Sequence
  Polynucleotide encoding a Synthetic Immune Receptor (SIR)
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1424 - DNA, 2862 bp, Artificial Sequence
  Polynucleotide encoding a Synthetic Immune Receptor (SIR)
atggccttaccagtgaccgccttgctcctgccgctggccttgctgctccacgccgccaggccgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1425 - DNA, 2871 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1426 - DNA, 3243 bp, Artificial Sequence
  Polynucleotide encoding a Synthetic Immune Receptor (SIR)
atggttaggggcgttccattcagacatctgcttctggtcttgcagcttgcactcttgcccgctgccacccagggcaaaaaagtggtgctgggcaagaaaggcgacaccgtggaactgacctgcaccgccagccagaagaagtccatccagttccactggaagaacagcaaccagatcaagatcctgggcaaccagggcagcttcctgaccaagggacccagcaagctgaacgacagagccgacagcagacggtccctgtgggaccagggcaatttcccactgattatcaagaacctgaagatcgaggacagcgacacctacatctgcgaggtggaagatcagaaagaagaggtgcaactgctggtgttcggcctgaccgccaactccgacacccatctgctccagggccagagcctgaccctgacactggaaagccctccaggcagctcccccagcgtgcagtgtagaagcccacgaggcaagaacatccagggaggcaaaacattgtcagtgtcccaactggaactccaggactccggcacctggacctgtaccgtgctccagaaccagaaaaaggtggagttcaagatcgacatcgtggtgctggccttccagaaagcctctctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaatctaccaggaactgacacaactgaaggccgccgtggaacggctgtgccacccttgtccttgggagtggaccttctttcagggcaactgctacttcatgagcaacagccagcggaactggcacgacagcatcaccgcctgcaaagaagtgggagcccaactggtcgtgattaagagcgccgaggaacagaacttcctccaactccagagcagcagaagcaacagattcacctggatgggcctgagcgacctgaaccaggaaggcacctggcagtgggtggacggatctcctctgctgcccagcttcaagcagtattggaaccggggcgagcccaacaacgtgggcgaagaggattgcgccgagttcagcggcaacggctggaacgacgacaagtgcaacctggctaagttctggatctgcaagaagtccgccgcctcctgtagccgggatgaggaacagttcctgagccctgcccctgccacccctaatcctccaccagctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1427 - DNA, 2871 bp, Artificial Sequence
  Polynucleotide encoding a Synthetic Immune Receptor (SIR)
atggccttaccagtgaccgccttgctcctgccgctggccttgctgctccacgccgccaggccggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1428 - DNA, 2871 bp, Artificial Sequence; identical to SEQ ID NO: 1427
  Polynucleotide encoding a Synthetic Immune Receptor (SIR)

SEQ ID NO: 1429 - DNA, 3333 bp, Artificial Sequence
  Polynucleotide encoding a Synthetic Immune Receptor (SIR)
atggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggcccttccagtcactgccttgctgttgcctctggcgctcctgctccacgccgctagaccgggcatgagaaccgaggacctgcctaaggccgtggtgttcctggaaccccagtggtacagagtgctggaaaaggacagcgtgaccctgaagtgccagggcgcctacagccccgaggacaatagcacccagtggttccacaacgagagcctgatctccagccaggccagcagctacttcatcgacgccgccaccgtggacgacagcggcgagtatagatgccagaccaacctgagcaccctgagcgaccccgtgcagctggaagtgcacatcggatggctgctgctgcaggcccccagatgggtgttcaaagaagaggaccccatccacctgagatgccactcttggaagaacaccgccctgcacaaagtgacctacctgcagaacggcaagggcagaaagtacttccaccacaacagcgacttctacatccccaaggccaccctgaaggactccggctcctacttctgcagaggcctcgtgggcagcaagaacgtgtccagcgagacagtgaacatcaccatcacccagggcctggccgtgtctaccatcagcagctttttcccacccggctaccagacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1430 - DNA, 3102 bp, Artificial Sequence
  Polynucleotide encoding a Synthetic Immune Receptor (SIR)
atggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1431 - DNA, 2871 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1432 - DNA, 2877 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1433 - DNA, 2880 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1434 - DNA, 2856 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1435 - DNA, 2874 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1436 - DNA, 2853 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1437 - DNA, 2868 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1438 - DNA, 2859 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1439 - DNA, 2889 bp, Artificial Sequence
  Polynucleotide encoding a Synthetic Immune Receptor (SIR)
atggccttaccagtgaccgccttgctcctgccgctggccttgctgctccacgccgccaggccggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1440 - DNA, 2877 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1441 - DNA, 2889 bp, Artificial Sequence
  Polynucleotide encoding a Synthetic Immune Receptor (SIR)
atggccttaccagtgaccgccttgctcctgccgctggccttgctgctccacgccgccaggccggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagagccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1442 - DNA, 2844 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1443 - DNA, 2871 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1444 - DNA, 2859 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1445 - DNA, 2883 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1446 - DNA, 2868 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1447 - DNA, 2853 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1448 - DNA, 2862 bp, Artificial Sequence
  Polynucleotide encoding a Synthetic Immune Receptor (SIR)
atggccttaccagtgaccgccttgctcctgccgctggccttgctgctccacgccgccaggccggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1449 - DNA, 2847 bp, Artificial Sequence
  Polynucleotide encoding a Synthetic Immune Receptor (SIR)
atggccttaccagtgaccgccttgctcctgccgctggccttgctgctccacgccgccaggccgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1450 - DNA, 2877 bp, Artificial Sequence
  Polynucleotide encoding a Synthetic Immune Receptor (SIR)
atggccttaccagtgaccgccttgctcctgccgctggccttgctgctccacgccgccaggccggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1451 - DNA, 2853 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1452 - DNA, 2862 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1453 - DNA, 2892 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1454 - DNA, 2883 bp, Artificial Sequence
  Polynucleotide encoding a Synthetic Immune Receptor (SIR)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1455 - DNA, 2859 bp, Artificial Sequence
  Polynucleotide encoding a Synthetic Immune Receptor (SIR)
atggccttaccagtgaccgccttgctcctgccgctggccttgctgctccacgccgccaggccggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1456 - DNA, 2838 bp, Artificial Sequence
  Polynucleotide encoding a Synthetic Immune Receptor (SIR)
atggccttaccagtgaccgccttgctcctgccgctggccttgctgctccacgccgccaggccgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1457 - DNA, 2853 bp, Artificial Sequence
  Polynucleotide encoding a Synthetic Immune Receptor (SIR)
atggccttaccagtgaccgccttgctcctgccgctggccttgctgctccacgccgccaggccgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1458 - DNA, 2889 bp, Artificial Sequence
  Polynucleotide encoding a Synthetic Immune Receptor (SIR)
atggaaatgttccagggcctgctgctgctcctgctgctttctatgggaggcacatgggccagcagagagatgctgaggcccagatgcagacccatcaatgccacactggccgtggaaaaagagggctgccctgtctgcatcaccgtgaacaccacaatctgcgccggctactgccccaccatgacaagagttctgcaaggcgtgctgcccgctctgcctcaggtcgtgtgcaactatcgggacgtccgcttcgagagcatcagactgcctggatgtcccagaggcgtgaaccctgtggtgtcttatgccgtggctctgagctgtcagtgcgccctgtgtagaagaagcaccaccgattgcggcggacccaaggatcaccctctgacctgtgacgaccctagattccaggccagcagcagctctaaagcccctccaccttctctgccatctccaagcagactgcccggacctagcgacacacctattctgcctcaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1459 - DNA, 2862 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1460 - DNA, 2877 bp, Artificial Sequence
  Polynucleotide encoding a Synthetic Immune Receptor (SIR)
atggccttaccagtgaccgccttgctcctgccgctggccttgctgctccacgccgccaggccggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1461 - DNA, 2910 bp, Artificial Sequence
  Polynucleotide encoding a Synthetic Immune Receptor (SIR)
atggccttaccagtgaccgccttgctcctgccgctggccttgctgctccacgccgccaggccggacctgaacttcatgctgacccagccccacagcgtgtccggcagccctggaaagaccgtgaccatctcctgcaccagaagcaccggcagcatcaccagcaactacgtgcactggtatcagcagaggcccggcagcagccctaccaccgtgatctgcgaggacaacgagaggccaagcggcgtgcccgatagattcagcggctccatcgacatcagcagcaacagcgccagcctgaccatcagcggcctgaaaaccgaggacgaggccgactactactgccagagctacgacgacagcaaccacatctccgtgttcggcaccgggaccaaagtgaccgtgctgggacagcccaaggccaatcctctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcaggaatctggccctggcctcgtgaagcccagcgagacactgagcctgacctgcacagtgtccggcggcagcattagcagcagcaattactactggggctggattcggcagccccctggcaagggactggaatggatcggagccatctactacagcggcagcacctactacaaccccagcctgaagtccagagtggctatcagcgtggacaccagcaagaaccagttctccctgaagctgagcagcgtgacagccgccgataccgccgtgtactactgcgccagacggatcggagtggccggacagtggtacttcgacctgtggggcagaggaaccctcgtgaccgtgtctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1462 - DNA, 2868 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1463 - DNA, 2862 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1464 - DNA, 2862 bp, Artificial Sequence
  Polynucleotide encoding a Synthetic Immune Receptor (SIR)
atggccttaccagtgaccgccttgctcctgccgctggccttgctgctccacgccgccaggccggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1465 - DNA, 2880 bp, Artificial Sequence
  Polynucleotide encoding a Synthetic Immune Receptor (SIR)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1466 - DNA, 2880 bp, Artificial Sequence
  Polynucleotide encoding a Synthetic Immune Receptor (SIR)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1467 - DNA, 2901 bp, Artificial Sequence
  Polynucleotide encoding a Synthetic Immune Receptor (SIR)
atggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1468 - DNA, 3132 bp, Artificial Sequence
  Polynucleotide encoding a Synthetic Immune Receptor (SIR)
atggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1469 - DNA, 3132 bp, Artificial Sequence
  Polynucleotide encoding a Synthetic Immune Receptor (SIR)
atggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggcccttccagtcactgccttgctgttgcctctggcgctcctgctccacgccgctagaccgggcatgagaaccgaggacctgcctaaggccgtggtgttcctggaaccccagtggtacagagtgctggaaaaggacagcgtgaccctgaagtgccagggcgcctacagccccgaggacaatagcacccagtggttccacaacgagagcctgatctccagccaggccagcagctacttcatcgacgccgccaccgtggacgacagcggcgagtatagatgccagaccaacctgagcaccctgagcgaccccgtgcagctggaagtgcacatcggatggctgctgctgcaggcccccagatgggtgttcaaagaagaggaccccatccacctgagatgccactcttggaagaacaccgccctgcacaaagtgacctacctgcagaacggcaagggcagaaagtacttccaccacaacagcgacttctacatccccaaggccaccctgaaggactccggctcctacttctgcagaggcctcgtgggcagcaagaacgtgtccagcgagacagtgaacatcaccatcacccagggcctggccgtgtctaccatcagcagctttttcccacccggctaccagacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1470 - DNA, 3282 bp, Artificial Sequence
  Polynucleotide encoding a Synthetic Immune Receptor (SIR)
atggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcgccaccatggccctgcctgtgacagctctgctgctgcctctggcactgctgctgcacgccgccagacctgatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1471 - DNA, 2901 bp, Artificial Sequence
  Polynucleotide encoding a Synthetic Immune Receptor (SIR)
atggccttaccagtgaccgccttgctcctgccgctggccttgctgctccacgccgccaggccggacgaattcgaggtgcagctggtagaatccggcgggggacttgtacaggctggtggtagtctgagactgagctgtgtggcctccggcatcagcagcagcaagcggaacatgggatggtataggcaagcccctggtaagcagagggaatccgtggctacaatcagcagcggcggcaacaaggactacaccgacgccgtgaaggacaggttcaccatctccagggacaccaccaagaacaccgtgtacctgcagatgaactccctcaagcccgaggacaccgccgtgtactactgcaagatcgaggccggcacaggctgggccaccagaagaggctacacatactgggggcagggaacactggtgaccgtgagctccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1472 - DNA, 2943 bp, Artificial Sequence
  Polynucleotide encoding a Synthetic Immune Receptor (SIR)
atggccttaccagtgaccgccttgctcctgccgctggccttgctgctccacgccgccaggccggacgaattcgaggtgcaactggtggaaagcggcggaggactggtgcaggctggcgatagcctgagactgagctgtgccgcctccggcagagccttcagcagatatgccatgggctggttcagacaggcccctggcaaagaacgcgagttcgtggccgccatcggctggggacctagcaagaccaactacgccgacagcgtgaagggccggttcaccatcagccgggacaacgccaagaacaccgtgtacctgcagatgaacaccctgaagcccgaggacaccgccgtgtactcttgcgccgccaagttcgtgaacaccgacagcacctggtcccgcagcgagatgtacacctattggggccagggcaccctcgtgaccgtgtctagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1473 - DNA, 2874 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1474 - DNA, 2859 bp, Artificial Sequence
  Polynucleotide encoding a Synthetic Immune Receptor (SIR)
atggccttaccagtgaccgccttgctcctgccgctggccttgctgctccacgccgccaggccggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1475 - DNA, 2862 bp, Artificial Sequence
  Polynucleotide encoding a Synthetic Immune Receptor (SIR)
atggccttaccagtgaccgccttgctcctgccgctggccttgctgctccacgccgccaggccggacagcaccgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacctggccagcaacctgcagagcggcgtgcccagcagattttctggcagcggctccggcaccgacttcaccctgacaatcagctccctgcagcccgaggacttcgccacctactactgtcagcaggccgagtacatgcccctgaccttcggccagggaacaaaggtggaaatcaagagagccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactgctggaatctggcggcggactggtgcagcctggcggatctctgagactgagctgtgccgccagcggcttcacctttagcggctacgccatgagctgggtgcgccaggctcctggcaaaggcctggaatgggtgtccgagatcgcccctcccggcctgaataccagatacgccgatagcgtgaagggccggttcaccatcagccgggacaacagcaagaacaccctgtacctgcagatgaacagcctgcgggccgaggataccgccgtgtactactgcgccaagagcgacaccgccttcgactactggggacagggaacccttgtgaccgtgtccacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1476 - DNA, 2871 bp, Artificial Sequence
  Polynucleotide encoding a Synthetic Immune Receptor (SIR)
atggccttaccagtgaccgccttgctcctgccgctggccttgctgctccacgccgccaggccggaccaggccgtgctgacccaggagagcgccctgaccaccagccccggcgagaccgtgaccctgacctgcagaagcagcaccggcgccgtgaccaccagcaactacgccaactgggtgcaggagaagcccgaccacctgttcaccggcctgatcggcggcaccaacaacagagtgcccggcgtgcccgccagattcagcggcagcctgatcggcgacaaggccgccctgaccatcaccggcgcccagaccgaggacgaggccatctacttctgcgtgctgtggcacagcaaccactgggtgttcggcggcggcaccaagctgaccgtgctgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagacgtgcagctggtggagagcggcggcggcctggtgcagcccggcggcagcagaaagctgagctgcgccgccagcggcttcaccttcagcagcttcgggatgcactgggtgagacaggcccccgagaagggcctggagtgggtggcctacatcagcagcggcagcagcaccctgcactacgccgacaccgtgaagggcagattcaccatcagcagagacaaccccaagaacaccctgttcctgcagatgaccagcctgagaagcgaggacaccgccatgtactactgcgccagatggggcaactacccccactacgctatggactactggggccagggcaccagcgtgaccgtgagcagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1477 - DNA, 2937 bp, Artificial Sequence
  Polynucleotide encoding a Synthetic Immune Receptor (SIR)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactggtggaatccgggggaggcagcgtgcaggctgggggatcactgagactgtcttgtgctgcctccggcgacacctacggcagctattggatgggatggtttcggcaggctcccggaaaagaacgggaaggcgtggccgccatcaacagaggcggcggatacaccgtgtacgccgactctgtgaagggcagattcacaatctccagagacacagccaagaatactgtgtacctgcagatgaactccctgcgccccgacgataccgccgactattattgcgccgcttccggcgtgctgggcggcctgcatgaggactggttcaattattggggacagggaacacttgtgacagtgtccagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1478 - DNA, 2928 bp, Artificial Sequence
  Polynucleotide encoding a Synthetic Immune Receptor (SIR)
atggccctgcccgtgacagccctgctgctgcctctggctctgctgctgcacgccgccagacccgatgaattcgaggtgcagctcgtagaatctggaggtggttccgtgcaagccggaggatcattgcgactgacctgcgcagcgagcggatctacttctcgctcttacggtatgggatggttcagacaggctcctgggaaagagcgcgagttcgtttcaggcatctcctggaggggggacagcaccggctacgcagatagcgtgaagggcaggttcacgatcagccgagacaacgccaaaaacaccgtcgatctgcaaatgaatagtctgaagcccgaagatactgcgatctactactgtgccgccgcagcagggtccacctggtacggcacactctacgagtacgactactgggggcagggaaccctggtaaccgtgtcctctctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcagctcgtggaaagcggtggcggaagtgtgcaggccggaggcagtttgcgcctgagctgcgctgcttccggcgatacatacgggtcttactggatgggctggtttaggcaggcacctggacaagaaagagaagctgtggccgctattaacaggggaggtggctataccgtttatgctgattccgtgaagggccgattcacaatctcccgggataacgccaaaaacactctgtacctgcagatgaactcccttaggcccgatgacacagccgattactattgtgcggcctccggcgtgctgggtggtctgcatgaggattggttcaactactgggggcaaggcaccctcgtaaccgtgagtagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1479 - DNA, 2844 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1480 - DNA, 2862 bp, Artificial Sequence
  Polynucleotide encoding a Synthetic Immune Receptor (SIR)
atggccttaccagtgaccgccttgctcctgccgctggccttgctgctccacgccgccaggccggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1481 - DNA, 2883 bp, Artificial Sequence
  Polynucleotide encoding a Synthetic Immune Receptor (SIR)
atggccttaccagtgaccgccttgctcctgccgctggccttgctgctccacgccgccaggccggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1482 - DNA, 2886 bp, Artificial Sequence
  Polynucleotide encoding a Synthetic Immune Receptor (SIR)
atggccttaccagtgaccgccttgctcctgccgctggccttgctgctccacgccgccaggccggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1483 - DNA, 2877 bp, Artificial Sequence
  Polynucleotide encoding a Synthetic Immune Receptor (SIR)
atggccttaccagtgaccgccttgctcctgccgctggccttgctgctccacgccgccaggccggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1484 - DNA, 2868 bp, Artificial Sequence
  Polynucleotide encoding a Synthetic Immune Receptor (SIR)
atggccttaccagtgaccgccttgctcctgccgctggccttgctgctccacgccgccaggccggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1485 - DNA, 2874 bp, Artificial Sequence
  Polynucleotide encoding a Synthetic Immune Receptor (SIR)
atggccttaccagtgaccgccttgctcctgccgctggccttgctgctccacgccgccaggccggacatccagatgacacagagccctagcagcctgtctgccagcgtgggagacagagtgaccatcacctgtagaaccagccagagcctgagcagctacacccactggtatcagcagaagcctggcaaggcccctaagctgctgatctatgccgcttccagcagaggcagcggagtgcctagcagattttctggcagcggctccggcaccgatttcaccctgacaatatccagcctccagcctgaggacttcgccacctactactgccagcagagcagaacattcggccagggcaccaaggtggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctccagcagtctggccctggcctggttaagcctagccagacactgagcctgacctgtgccatcagcggcgatagcgtgtccagctacaacgccgtgtggaactggatcagacagagcccatccagaggactggaatggctgggcagaacctactacagaagcggctggtacaacgactacgccgagagcgtgaagtcccggatcaccatcaatcccgacaccagcaagaaccagttcagcctgcaactgaacagcgtgacccctgaggataccgccgtgtactactgtgctagaagcggccacatcaccgtgttcggcgtgaacgtggacgccttcgatatgtggggccagggaacaatggtcaccgtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1486 - DNA, 2871 bp, Artificial Sequence
  Polynucleotide encoding a Synthetic Immune Receptor (SIR)
atggccttaccagtgaccgccttgctcctgccgctggccttgctgctccacgccgccaggccggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1487 - DNA, 2790 bp, Artificial Sequence
  Polynucleotide encoding a Synthetic Immune Receptor (SIR)
atggccttaccagtgaccgccttgctcctgccgctggccttgctgctccacgccgccaggccgaacagctgcgagctgaccaacatcacaatcgccatcgagaaagaggaatgccggttctgcatcagcatcaacaccacttggtgcgccggctactgctacacccgcgatctggtgtataaggaccccgccagacctaagatccagaaaacctgcaccttcaaagagctggtctacgagacagtcagagtgcctggatgtgcccaccacgccgatagcctgtacacataccctgtggctacccagtgccactgcggcaagtgtgatagcgacagcaccgattgcaccgtcagaggactgggacccagctactgtagcttcggcgagatgaaggaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1488 - DNA, 2862 bp, Artificial Sequence
  Polynucleotide encoding a Synthetic Immune Receptor (SIR)
atggccttaccagtgaccgccttgctcctgccgctggccttgctgctccacgccgccaggccggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1489 - DNA, 2856 bp, Artificial Sequence
  Polynucleotide encoding a Synthetic Immune Receptor (SIR)
atggccttaccagtgaccgccttgctcctgccgctggccttgctgctccacgccgccaggccggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1490 - DNA, 2862 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1491 - DNA, 2868 bp, Artificial Sequence
  Polynucleotide encoding a Synthetic Immune Receptor (SIR)
atggccttaccagtgaccgccttgctcctgccgctggccttgctgctccacgccgccaggccgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1492 - DNA, 2883 bp, Artificial Sequence
  Polynucleotide encoding a Synthetic Immune Receptor (SIR)
atggccttaccagtgaccgccttgctcctgccgctggccttgctgctccacgccgccaggccgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1493 - DNA, 2865 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1494 - DNA, 2868 bp, Artificial Sequence
  Polynucleotide encoding a Synthetic Immune Receptor (SIR)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1495 - DNA, 2862 bp, Artificial Sequence
  Polynucleotide encoding a Synthetic Immune Receptor (SIR)
atggccttaccagtgaccgccttgctcctgccgctggccttgctgctccacgccgccaggccgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1496 - DNA, 2859 bp, Artificial Sequence
  Polynucleotide encoding a Synthetic Immune Receptor (SIR)
atggccttaccagtgaccgccttgctcctgccgctggccttgctgctccacgccgccaggccgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

(The sequence listing continues in the following parts.)

What is claimed is:

1. An at least one recombinant polynucleotide encoding a synthetic immune receptor (SIR), wherein the SIR comprises a heterodimer of two T-cell receptor (TCR) constant chains selected from (a)(i) and (a)(ii), (a)(i) and (a)(iii), (a)(iv) and (a)(ii), (a)(iv) and (a)(iii), and (a)(v) and (a)(vi) below, wherein the TCR constant chains of the encoded SIR comprise:

(a) an amino acid sequence selected from the group consisting of:

(i) an amino acid sequence that is at least 85% identical to SEQ ID NO:3010 and has one or more mutations at positions 10, 15, 45, 48, 61, 91, 92, 93, and/or 94;

(ii) an amino acid sequence that is at least 85% identical to SEQ ID NO:3024 and has one or more mutations at positions 15, 17, 18, 22, 57, 59, 77, 79, 133, 136 and/or 139;

(iii) an amino acid sequence that is at least 85% identical to SEQ ID NO: 3025 and has one or more mutations at position 15, 17, 18, 22, 57, 59, 77, 79, 133, 136 and/or 139;

(iv) an amino acid sequence that is at least 85% identical to SEQ ID NO: 3046, 3047 or 3048;

(v) an amino acid sequence that is at least 90% identical to SEQ ID NO:3049; or (vi) an amino acid sequence that is at least 85% identical to SEQ ID NO: 3051 or 3052; and (b) an optional linker; and (c) one or more non-natural TCR antigen binding domain(s) linked to (a) selected from the group consisting of:

(1) an antibody;

(2) an antibody fragment selected from the group consisting of a Fv, a Fab, and a (Fab')2;

(3) a heavy chain variable region of an antibody (vH domain) and a light chain variable region of an antibody (vL domain) specific for a target antigen, such that one of said vH and vL domains is attached to a first of said two TCR constant chains of (a) and the other of said vH and vL domains is attached to a second of said TCR constant chains of (a);

(4) a single chain variable fragment (scFv);

(5) a single domain antibody (SDAB);

(6) a camelid VHH domain;

(7) a monomeric variable region of an antibody;

(8) a non-immunoglobulin antigen binding scaffold selected from the group consisting of a DARPIN, an affibody, an affilin, an adnectin, an affitin, an obody, a repebody, a fynomer, an alphabody, an avimer, an atrimer, a centyrin, a pronectin, an anticalin, a kunitz domain, an Armadillo repeat protein and a functional fragment thereof;

(9) a receptor or a fragment thereof;

(10) a ligand or a fragment thereof; and

(11) an autoantigen or a fragment thereof.

2. The recombinant polynucleotide of claim 1, wherein the one or more non-natural TCR antigen binding domains are selected from the group consisting of:
- two single chain variable fragments (scFv) specific for one or more target antigens, such that, when expressed, one of said scFv is attached to one of said two chains of said T-cell constant chains and the other of said scFv is attached to the other of said two chains of said T-cell constant chains;
- two antibody fragments specific for one or more target antigens, such that, when expressed, one of said antibody fragments is attached to one of said two chains of said T-cell constant chains and the other of said antibody fragments is attached to the other of said two chains of said T-cell constant chains;
- two single domain antibody (SDAB) fragments specific for one or more target antigens, such that, when expressed, one of said SDAB fragments is attached to one of said two chains of said T-cell constant chains and the other of SDAB fragments is attached to the other of said two chains of said T-cell constant chains;
- two camelid vHH domains specific for one or more target antigens, such that, when expressed, one of said vHH domains is attached to one of said two chains of said T-cell constant chains and the other of vHH domains is attached to the other of said two chains of said T-cell constant chains;
- two non-immunoglobulin antigen binding scaffolds specific for one or more-target antigens, such that, when expressed, one of said non-immunoglobulin antigen binding scaffolds is attached to one of said two chains of said T-cell constant chains and the other of said non-immunoglobulin antigen binding scaffolds domains is attached to the other of said two chains of said T-cell constant chains;
- two receptors or a fragment thereof specific for one or more target antigens, such that, when expressed, one of said receptors or a fragment thereof is attached to one of said two chains of said T-cell constant chains and the other of said receptors or a fragment thereof is attached to the other of said two chains of said T-cell constant chains;
- two ligands or a fragment thereof specific for one or more target antigens, such that, when expressed, one of said ligands or a fragment thereof is attached to one of said two chains of said T-cell constant chains and the other of said ligands or a fragment thereof is attached to the other of said two chains of said T-cell constant chains;
- two structurally distinct antigen binding fragments specific for one or more-target antigens, such that, when expressed, one of said antigen binding fragments is attached to one of said two chains of said T-cell constant chains and the other of said antigen binding fragments is attached to the other of said two chains of said T-cell constant chains;
- two autoantigens or fragments thereof, such that, when expressed, one of said autoantigens or fragments thereof is attached to one of said two chains of said T-cell constant chains and the other of said autoantigens or fragments thereof is attached to the other of said two chains of said T-cell constant chains.

3. The recombinant polynucleotide of claim 1, wherein the polynucleotide encoding the TCR constant chain of (a) encodes a TCR constant chain(s) wherein the one or more mutations enhance the expression and/or pairing of TCR constant chains and reduce their pairing with the endogenous T cell receptor chains, wherein the one or more mutations are selected from the group consisting of:
   (i) codon-optimization;
   (ii) a nucleic acid sequence encoding the amino acid sequence of (a)(i), wherein said nucleic acid sequence comprises SEQ ID NO: 730 to 743 with 1-40 modifications;
   (iii) a nucleic acid sequence encoding the amino acid sequence of (a)(ii) or (a)(iii), wherein said nucleic acid sequence comprises SEQ ID NO: 744 to 765 with 1-40 modifications;
   (iv) a nucleic acid sequence encoding the amino acid sequence of (a)(v), wherein said nucleic acid sequence comprises SEQ ID NO: 769 to 770 with 1-40 modifications;
   (v) a nucleic acid sequence encoding the amino acid sequence of (a)(vi), wherein said nucleic acid sequence comprises SEQ ID NO: 771 to 772 with 1-40 modifications; and
   (vi) a nucleic acid sequence encoding the amino acid sequence of (a)(iv), wherein said nucleic acid sequence comprises SEQ ID NO: 766 to 768 with 1-40 modifications.

4. The recombinant polynucleotide of claim 1, wherein said one or more non-natural TCR antigen binding domain(s) binds to an antigen selected from a group consisting of: CD19; CDS; CD123; CD22; CD30; CD171; CS-1 (also referred to as CCD2 subset 1, CRACC, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3; TNF receptor family member B cell maturation (BCMA); Tn antigen ((Tn Ag) or (GalNAca-Ser/Thr)); prostate-specific membrane antigen (PSMA); Receptor tyrosine kinase-like orphan receptor 1 (ROR1); Fms Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors; a glycosylated CD43 epitope expressed on non-hematopoietic cancers; Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-IIRa); prostate stem cell antigen (PSCA); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); carbonic anhydrase IX (CAIX); tyrosinase; Fucosyl GM1; sialyl Lewis adhesion molecule (sLe); ganglioside GM3; transglutaminase 5 (TGS5); high molecular weight-melanoma associated antigen (HMWMAA); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); mammary gland differentiation antigen (NY-BR-1); Wilms tumor protein (WT1); Cancer/testis antigen 1 (NY-ES0-1); Melanoma-associated antigen 1 (MAGE-A1); melanoma antigen recognized by T cells 1 (MelanA or MARTI); Rat sarcoma (Ras) mutant; human Telomerase reverse transcriptase (hTERT); human papilloma virus E6 (HPV E6); human papilloma virus E7 (HPV E7); CD79a; CD79b; CD72; Leukocyte-associated immunoglobulin-like receptor 1 (LAIR1); C-type lectin domain family 12 member A (CLEC12A); EGF-like module-containing mucin-like hormone receptor-like 2 (EMR2); lymphocyte antigen 75 (LY75); Glypican-3 (GPC3); Fc receptor-like 5 (FCRL5); immunoglobulin lambda-like polypeptide 1 (IGLL1); MPL; Biotin; c-MYC epitope Tag; CD34; LAMP1 TROP2; GFRalpha4; CDH17; CDH6; CDH19; CD200R; Slea (CA19.9; Sialyl Lewis Antigen) Fucosyl-GM1; PTK7; CDH1-CD324; DLL3; CD276/B7H3; IL11Ra; IL13Ra2; CD179b-1GL11; TCR gamma-delta; NKG2D; CD32 (FCGR2A); CSPG4-HMW-MAA; Tim1-/HVCR1; CSF2RA (GM-CSFR-alpha); TGFbetaR2; VEGFR2/KDR; Lewis Ag; TCR-beta1 chain; TCR-beta2 chain; TCR-gamma chain; TCR-delta chain; FITC; Luteinizing hormone receptor (LHR); Follicle stimulating hormone receptor (FSHR); Chorionic Gonadotropin Hormone receptor (CGHR); CCR4; GD3; SLAMF6; SLAMF4; HIV1 envelope glycoprotein; HTLV1-Tax; CMV pp65; EBV-EBNA3c; influenza A hemagglutinin (HA); GAD; PDL1; Guanylyl cyclase C (GCC); KSHV-K8.1 protein; KSHV-gH protein; auto antibody to desmoglein 3 (Dsg3); autoantibody to desmoglein 1 (Dsg1); HLA-A2; HLA-B; HLA-C; HLA-DP; HLA-DM; HLA-DOA; HLA-DOB; HLA-DQ; HLA-DR; HLA-G; IGE; CD99; Lym1; Lym2; RAS G12V; Tissue Factor 1 (TF1); AFP; GPRC5D; claudin18.2 (CLD18A2 OR CLDN18A.2); STEAP1; LIV1; NECTIN-4; CRIPTO; GPA33; BST1/CD157; low conductance chloride channel; and antigen recognized by TNT antibody.

5. The recombinant polynucleotide of claim 4, wherein said one or more non-natural TCR antigen binding domain(s) is selected from the group consisting of:
   (i) a heavy chain variable region (vH) encoded by a polynucleotide having a sequence of SEQ ID NO: 226 to 400 or 10203 to 10321 or a sequence with at least 95% identity thereto that contains the complementarity determining regions (CDRs) of SEQ ID NO: 226 to 400 or 10203 to 10321 and which encodes a polypeptide that binds to its antigen; and a complementary a light chain variable region (vL) encoded by a polynucleotide having a sequence of SEQ ID NO: 16 to 191 or 10085 to 10202 or a sequence with at least 95% identity thereto that contains the complementarity determining regions (CDRs) of SEQ ID NO: 16 to 191 or 10085 to 10202 and which encodes a polypeptide that binds to its antigen;
   (ii) a single chain variable fragment (scFv) encoded by a polynucleotide having a sequence of SEQ ID NO: 488 to 657, 10346 to 10400 or 18098 to 18160 or a sequence with at least 95% identity thereto that contains the complementarity determining regions (CDRs) of SEQ ID NO: 488 to 657, 10346 to 10400 or 18098 to 18160 and which encodes a polypeptide that binds to its antigen;
   (iii) a camelid VHH domain encoded by a polynucleotide having a sequence of SEQ ID NO: 421 to 445 or 10322 to 10337 or a sequence with at least 95% identity thereto that contains the complementarity determining regions (CDRs) of SEQ ID NO: 421 to 445 or 10322 to 10337 and which encodes a polypeptide that binds to its antigen;
   (iv) a non-immunoglobulin scaffold encoded by a polynucleotide having a sequence of SEQ ID NO: 439 to 443 or a sequence with at least 95% identity thereto and which encodes a polypeptide that binds to its antigen;
   (v) a receptor encoded by a polynucleotide having a sequence of SEQ ID NO: 456 to 468 or a sequence with at least 95% identity thereto and which encodes a polypeptide that binds to its cognate;
   (vi) a ligand encoded by a polynucleotide having a sequence of SEQ ID NO: 476 to 486 or 10402 to 10404 or a sequence with at least 95% identity thereto and which encodes a polypeptide that binds to its cognate; and
   (vii) a light chain variable region (VL) that comprises three light chain complementary determining regions for a selected target antigen as set forth in-any of SEQ ID NO: 13999 to 14879 or 14880 and a complementary heavy chain variable region (VH) that comprises three heavy chain complementary determining regions for a selected target antigen as set forth SEQ ID NO: 14881 to 15761 or 15762.

6. The recombinant polynucleotide of claim 4, wherein said one or more non-natural TCR antigen binding domain(s) bind to CD19 and comprise a polypeptide sequence selected from the group consisting of:
   (i) a polypeptide comprising a sequence that is at least 95% identical to SEQ ID NO: 2318-2324, 12060-12068, 12108, 12127, or 12156 and that contains the complement determining regions (CDRs) of SEQ ID NO: 2318-2324, 12060-12068, 12108, 12127, or 12156;
   (ii) a polypeptide comprising a sequence that is at least 95% identical to SEQ ID NO: 2517-2523, 12178-12186, 12227, 12246 or 12275 and that contains the complement determining regions (CDRs) of SEQ ID NO: 2517-2523, 12178-12186, 12227, 12246 or 12275;
   (iii) a polypeptide comprising a sequence that is at least 95% identical to SEQ ID NO: 12288 and that contains the complementarity determining regions (CDRs) of SEQ ID NO: 12288; and
   (iv) a polypeptide comprising a sequence that is at least 95% identical to SEQ ID NO: 2770-2774, 12325, 12308, 18162-18170 or 12354 and that contains the complementarity determining regions (CDRs) of SEQ ID NO: 2770-2774, 12325, 12308, 18162-18170 or 12354.

7. The recombinant polynucleotide of claim 6, wherein the recombinant polynucleotide encodes a polypeptide comprising a sequence selected from the group consisting of SEQ ID Nos: 3135-3235, 3250-3346, 3396, 3401-3403, 3406, 3429-3432, 3435-3439, 3540, 3855-3859, 12431-12489, 12491-12493, 12495-12530, 12534, 13195-13203, 13249, 13267, 13289, 13429-13437, 13483, 13501, 13523, 3645-3647, 13312-13314, 13317-13320, 13366, 13406, 4069-4072, 13546-13549, 13553-13554, 13600, 13640, 4284-4287, 13665-13668, 13671-13673, 13719, 13759, 6044-6046, 6048, 13782-13785, 13788-13790, 13836, 13876, 7094-7097, 16595-16598, 16601-16603, 16649, 16689, 7304-7308, 17999-18002, 18005-18007, 18053, 18093, 12553-12555, 12557, 12765-12768, 12771-12773, 12819, 12859, 12865-12867, 12869, 13077-13080, 13083-13086, 13131, 13171, 16478-16481, 16484-16486, 16649, 16689, 18239-18240, 19248-19250, 19252, 19460-19463, 19466-19468, 19514 and 19554.

8. The recombinant polynucleotide of claim 1, wherein said one or more non-natural TCR antigen binding domain(s) are selected from the group consisting of:
   (i) a variable light (vL) domain comprising a sequence SEQ ID NO: 2307 to 2482 or 12042 to 12159 having up to 10 conservative amino acid substitutions and that contains the complementarity determining regions (CDRs) of SEQ ID NO: 2307 to 2482 or 12042 to 12159; and a complementary variable heavy (vH)

domain comprising a sequence of SEQ ID NO: 2506 to 2680 or 12160 to 12278 having up to 10 conservative amino acid substitutions and that contains the complementarity determining regions (CDRs) of SEQ ID NO: 2506 to 2680 or 12160 to 12278;
- (ii) one or more of camelid vHH domains as set forth in SEQ ID NO: 2701 to 2725 or 12279 to 12294 having up to 10 conservative amino acid substitutions and that contains the complementarity determining regions (CDRs) of SEQ ID NO: 2701 to 2725 or 12279 to 12294 and which binds to its antigen;
- (iii) a non-immunoglobulin antigen binding domain having a sequence as set forth in SEQ ID NO: 2728-2732 or 12296 to 12301 and having up to 10 conservative amino acid substitutions and which binds to its antigen;
- (iv) an scFv domain comprising three light chain complementary determining regions of a variable light (vL) domain comprising a sequence of SEQ ID NO: 2307 to 2482 or 12042 to 12159 and three heavy chain complementary determining regions of a variable heavy (vH) domain comprising a sequence of SEQ ID NO: 2506 to 2680 or 12160 to 12278;
- (v) an scFv fragment having a sequence selected from the group consisting of SEQ ID NO: 2770 to 2939, 12303 to 12357 or 18162 to 18224 each having up to 10 conservative amino acid substitutions and that contains the complementarity determining regions (CDRs) of SEQ ID NO: 2770 to 2939, 12303 to 12357 or 18162 to 18224 and which binds to its antigen;
- (vi) one or more receptors comprising the amino acid sequence of SEQ ID NO: 2736 to 2748 having up to 10 conservative amino acid substitutions;
- (vii) one or more ligands comprising the sequence of SEQ ID NO: 2758-2768 or 12359 to 12361 having up to 10 conservative amino acid substitutions;
- (viii) an extracellular domain of CD16A, NKG2D, CD4, PD1, desmoglein 3 (Dsg3), or CD4-DC-SIGN;
- (ix) an extracellular domain of one or more of hTPO, mTPO, CGHα chain, CGHβ chain, FHβ chain, LHβ chain, TSHβ chain, APRIL or a combination thereof; and
- (x) any combination of (i)-(ix).

9. The at least one recombinant polynucleotide of claim 1, wherein the at least one polynucleotide further comprises a sequence encoding an accessory module and/or a therapeutic control, wherein the accessory module or therapeutic control is selected from the group consisting of 41BBL; CD40L; K13; MC159; cFLIP-L/MRITa; cFLIP-p22; HTLV1 Tax; HTLV2 Tax; HTLV2 Tax-RS mutant; FKBPx2-K13; FKBPx2-HTLV2-Tax; FKBPx2-HTLV2-Tax-RS; IL6R-304-vHH-Alb8-vHH; IL12f; PD1-4H1 scFV; PD1-5C4 scFV; PD1-4H1-Alb8-vHH; PD1-5C4-Alb8-vHH; CTLA4-Ipilimumab-scFv; CTLA4-Ipilimumab-Alb8-vHH; IL6-19A-scFV; IL6-19A-scFV-Alb8-vHH; sHVEM; sHVEM-Alb8-vHH; hTERT; Fx06; CD3z; CD3z-GGGS-41BB; CD3-BBz; CD3-CD28z; CD3-CD28-Lck fusion protein; shRNA targeting Brd4; chimeric antigen receptor (CAR); hTERT; heparinase; a costimulatory molecule; a CAR comprising an antigen binding domain, a transmembrane domain and a primary signaling domain; a CAR comprising an antigen binding domain, a transmembrane domain and a costimulatory domain; a CAR comprising an antigen binding domain, a transmembrane domain, a primary signaling domain and a costimulatory domain; a chimeric cytokine receptor (CCR); a cytokine; a chemokine; IL2; IL-7; IL-15; IL-21; an agent that increases the expression and/or activity of SIR chains, wherein optionally the agent is CD3ζ, CD3δ, CD3ε, CD3γ or combination thereof; a truncated epidermal growth factor receptor (tEGFR); a truncated epidermal growth factor receptor viii (tEGFRviii); a truncated CD30 (tCD30); a truncated BCMA (tBCMA); a truncated CD19 (tCD19); CD34, thymidine kinase; cytosine deaminase; nitroreductase; xanthine-guanine phosphoribosyl transferase; human caspase 8; human caspase 9; inducible caspase 9 (icaspase9); purine nucleoside phosphorylase; linamarase/linamarin/glucose oxidase; deoxyribonucleoside kinase; horseradish peroxidase (HRP)/indole-3-acetic (IAA); Gamma-glutamylcysteine synthetase; CD20/alphaCD20; CD34/thymidine kinase chimera; dox-dependent caspase-2; mutant thymidine kinase (HSV-TKSR39); AP1903/Fas system; selection marker; dihydroxyfolate receptor (DHFR); mutant DHFR; methylated-DNA-protein-cysteine methyltransferase; inosine monophosphate dehydrogenase II (IMDHP2); puromycin acetyle transferase (PAC); blasticidin-resistance gene; mutant calcinueurin a/b (Can/b); CNa12; CNb30; a suicide gene; an agent that inhibits an inhibitory molecule; an agent that promotes the proliferation, persistence, expansion and activation of a SIR-expressing cell; an agent that inhibits the expression of one or more target antigens of SIR; an agent that mutates one or more target antigens of SIR; and combination thereof.

10. At least one vector comprising the at least one recombinant polynucleotide of claim 1, wherein the vector is selected from the group consisting of a DNA vector, an RNA vector, a plasmid, a lentivirus vector, adenoviral vector, a retrovirus vector, a baculovirus vector, a sleeping beauty transposon vector, and a piggyback transposon vector.

11. A recombinant immune effector cell or stem cell that can differentiate into an immune effector cell comprising at least one recombinant polynucleotide of claim 1.

12. The recombinant polynucleotide of claim 1, wherein the encoded SIR comprises a heterodimer of two T-cell receptor (TCR) constant chains comprising the amino acid sequences of SEQ ID NOs: 3010 and 3024 with mutations at the following amino acid positions:
- a) SEQ ID NO: 3010 with 48C and SEQ ID NO: 3024 with 57C; or
- b) SEQ ID NO: 3010 with 15C and SEQ ID NO: 3024 with 15C; or
- c) SEQ ID NO: 3010 with 45C and SEQ ID NO: 3024 with 59C; or
- d) SEQ ID NO: 3010 with 45C and SEQ ID NO: 3024 with 77C; or
- e) SEQ ID NO: 3010 with 10C and SEQ ID NO: 3024 with 17C; or
- f) SEQ ID NO: 3010 with 91S, 92D, 93V and/or 94P and any of the forgoing mutations listed for SEQ ID NO: 3010 in (a)-(e), and SEQ ID NO: 3024 with 18K/R, 22A, 133I, 136A and/or 139H and any of the forgoing mutations listed for SEQ ID NO: 3024 in (a)-(e); or
- g) SEQ ID NO: 3010 with 61R and SEQ ID NO: 3024 with 79G; or
- h) any combination of mutations set forth in (a)-(g).

13. An isolated synthetic immune receptor (SIR) polypeptide heterodimer wherein SIR polypeptide heterodimer comprises two T-cell receptor (TCR) constant chains selected from (a)(i) and (a)(ii), (a)(i) and (a)(iii), (a)(iv) and (a)(ii), (a)(iv) and (a)(iii), and (a)(v) and (a)(vi) below, wherein the TCR constant chains comprise:

(a) an amino acid sequence selected from the group consisting of:
  (i) an amino acid sequence that is at least 85% identical to SEQ ID NO:3010 and has one or more mutations at positions 10, 15, 45, 48, 61, 91, 92, 93, and/or 94;
  (ii) an amino acid sequence that is at least 85% identical to SEQ ID NO:3024 and has one or more mutations at positions 15, 17, 18, 22, 57, 59, 77, 79, 133, 136 and/or 139;
  (iii) an amino acid sequence that is at least 85% identical to SEQ ID NO: 3025 and has one or more mutations at position 15, 17, 18, 22, 57, 59, 77, 79, 133, 136 and/or 139;
  (iv) an amino acid sequence that is at least 85% identical to SEQ ID NO: 3046, 3047 or 3048;
  (v) an amino acid sequence that is at least 90% identical to SEQ ID NO:3049;
  (vi) an amino acid sequence that is at least 85% identical to SEQ ID NO: 3051 or 3052; and
(b) an optional linker; and
(c) one or more non-natural TCR antigen binding domain(s) linked to (a) selected from the group consisting of:
  (1) an antibody;
  (2) an antibody fragment selected from the group consisting of a Fv, a Fab, and a (Fab')2;
  (3) a heavy chain variable region of an antibody (vH domain) and a light chain variable region of an antibody (vL domain) specific for a target antigen, such that one of said vH and vL domains is attached to a first of said two TCR constant chains of (a) and the other of said vH and vL domains is attached to a second of said TCR constant chains of (a);
  (4) a single chain variable fragment (scFv);
  (5) a single domain antibody (SDAB);
  (6) a camelid VHH domain;
  (7) a monomeric variable region of an antibody;
  (8) a non-immunoglobulin antigen binding scaffold selected from the group consisting of a DARPIN, an affibody, an affilin, an adnectin, an affitin, an obody, a repebody, a fynomer, an alphabody, an avimer, an atrimer, a centyrin, a pronectin, an anticalin, a kunitz domain, an Armadillo repeat protein and a functional fragment thereof;
  (9) a receptor or a fragment thereof;
  (10) a ligand or a fragment thereof, and;
  (11) an autoantigen or a fragment thereof.

14. The isolated synthetic immune receptor (SIR) polypeptide heterodimer of claim 13, wherein the one or more non-natural TCR antigen binding domains are selected from the group consisting of:
  two single chain variable fragments (scFv) specific for one or more target antigens, such that, when expressed, one of said scFv is attached to one of said two chains of said T-cell constant chains and the other of said scFv is attached to the other of said two chains of said T-cell constant chains;
  two antibody fragments specific for one or more target antigens, such that, when expressed, one of said antibody fragments is attached to one of said two chains of said T-cell constant chains and the other of said antibody fragments is attached to the other of said two chains of said T-cell constant chains;
  two single domain antibody (SDAB) fragments specific for one or more target antigens, such that, when expressed, one of said SDAB fragments is attached to one of said two chains of said T-cell constant chains and the other of SDAB fragments is attached to the other of said two chains of said T-cell constant chains;
  two camelid vHH domains specific for one or more target antigens, such that, when expressed, one of said vHH domains is attached to one of said two chains of said T-cell constant chains and the other of vHH domains is attached to the other of said two chains of said T-cell constant chains;
  two non-immunoglobulin antigen binding scaffolds specific for one or more target antigens, such that, when expressed, one of said non-immunoglobulin antigen binding scaffolds is attached to one of said two chains of said T-cell constant chains and the other of said non-immunoglobulin antigen binding scaffolds domains is attached to the other of said two chains of said T-cell constant chains;
  two receptors or a fragment thereof specific for one or more target antigens, such that, when expressed, one of said receptors or a fragment thereof is attached to one of said two chains of said T-cell constant chains and the other of said receptors or a fragment thereof is attached to the other of said two chains of said T-cell constant chains;
  two ligands or a fragment thereof specific for one or more target antigens, such that, when expressed, one of said ligands or a fragment thereof is attached to one of said two chains of said T-cell constant chains and the other of said ligands or a fragment thereof is attached to the other of said two chains of said T-cell constant chains;
  two structurally distinct antigen binding fragments specific for one or more target antigens, such that, when expressed, one of said antigen binding fragments is attached to one of said two chains of said T-cell constant chains and the other of said antigen binding fragments is attached to the other of said two chains of said T-cell constant chains;
  two autoantigens or fragments fragment thereof, such that, when expressed, one of said autoantigens or fragments thereof is attached to one of said two chains of said T-cell constant chains and the other of said autoantigens or fragments thereof is attached to the other of said two chains of said T-cell constant chains.

15. The isolated synthetic immune receptor (SIR) polypeptide heterodimer of claim 13, comprising:
  a TCR constant domain of (i), (ii), (iii), (iv), (v), or (vi) wherein the one or more non-natural TCR binding domains are selected from the group consisting of:
    a variable region of the heavy chain (vH) of an antibody specific for a target antigen and a variable region of the light chain (vL) of an antibody specific for a target antigen;
    a single chain variable fragment (scFv) specific for a target antigen;
    an antibody fragment selected from the group consisting of Fv, a Fab, and a (Fab')2 specific for a target antigen;
    a single domain antibody (SDAB) fragment specific for a target antigen;
    a camelid vHH domain specific for a target antigen;
    a non-immunoglobulin antigen binding scaffold specific for a target antigen;
    a receptor specific for a target antigen or fragments thereof;
    a ligand specific for a target antigen or fragments thereof, and
    an autoantigen or a fragment thereof.

16. The isolated synthetic immune receptor (SIR) polypeptide heterodimer of claim 13, wherein the one or more mutations in the TCR constant chains of (a)(i) to (a)(iii) enhance the expression and/or pairing of TCR constant chains and reduce their pairing with endogenous T cell receptor chains.

17. The isolated synthetic immune receptor (SIR) polypeptide heterodimer of claim 13, wherein said one or more non-natural TCR antigen binding domain(s) binds to an antigen selected from the group consisting of: CD19; CD5; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3; TNF receptor family member B cell maturation (BCMA); Tn antigen ((Tn Ag) or (GalNAca-Ser/Thr)); prostate-specific membrane antigen (PSMA); Receptor tyrosine kinase-like orphan receptor 1 (ROR1); Fms Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors; a glycosylated CD43 epitope expressed on non-hematopoietic cancers; Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); vascular endothelial growth factor receptor 2 (VEGFR2); Lewis (Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); carbonic anhydrase IX (CAIX); tyrosinase; Fucosyl GM1; sialyl Lewis adhesion molecule (sLe); ganglioside GM3; transglutaminase 5 (TGS5); high molecular weight-melanoma associated antigen (HMWMAA); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); mammary gland differentiation antigen (NY-BR-1); Wilms tumor protein (WT1); Cancer/testis antigen 1 (NY-ES0-1); Melanoma-associated antigen 1 (MAGE-A1); melanoma antigen recognized by T cells 1 (MelanA or MART1); Rat sarcoma (Ras) mutant; human Telomerase reverse transcriptase (hTERT); human papilloma virus E6 (HPV E6); human papilloma virus E7 (HPV E7); CD79a; CD79b; CD72; Leukocyte-associated immunoglobulin-like receptor 1 (LAIR1); C-type lectin domain family 12 member A (CLEC12A); EGF-like module-containing mucin-like hormone receptor-like 2 (EMR2); lymphocyte antigen 75 (LY75); Glypican-3 (GPC3); Fc receptor-like 5 (FCRL5); immunoglobulin lambda-like polypeptide 1 (IGLL1); MPL; Biotin; c-MYC epitope Tag; CD34; LAMP1 TROP2; GFRalpha4; CDH17; CDH6; CDH19; CD200R; Slea (CA19.9; Sialyl Lewis Antigen) Fucosyl-GM1; PTK7; CDH1-CD324; DLL3; CD276/B7H3; IL11Ra; IL13Ra2; CD179b-IGLI1; TCR gamma-delta; NKG2D; CD32 (FCGR2A); CSPG4-HMW-MAA; Tim1-/HVCR1; CSF2RA (GM-CSFR-alpha); TGFbetaR2; VEGFR2/KDR; Lewis Ag; TCR-beta1 chain; TCR-beta2 chain; TCR-gamma chain; TCR-delta chain; FITC; hormone receptor (LHR); Follicle stimulating hormone receptor (FSHR); Chorionic Gonadotropin Hormone receptor (CGHR); CCR4; GD3; SLAMF6; SLAMF4; HIV1 envelope glycoprotein; HTLV1-Tax; CMV pp65; EBV-EBNA3c; influenza A hemagglutinin (HA); GAD; PDL1; Guanylyl cyclase C (GCC); KSHV-K8.1 protein; KSHV-gH protein; auto antibody to desmoglein 3 (Dsg3); autoantibody to desmoglein 1 (Dsg1); HLA-A2; HLA-B; HLA-C; HLA-DP; HLA-DM; HLA-DOA; HLA-DOB; HLA-DQ; HLA-DR; HLA-G; IGE; CD99; Lym1; Lym2; RAS G12V; Tissue Factor 1 (TF1); AFP; GPRC5D; claudin18.2 (CLD18A2 OR CLDN18A.2); STEAP1; LIV1; NECTIN-4; CRIPTO; GPA33; BST1/CD157; low conductance chloride channel; and antigen recognized by TNT antibody.

18. The isolated synthetic immune receptor (SIR) polypeptide heterodimer of claim 17, wherein said one or more non-natural TCR antigen binding domain(s) is selected from the group consisting of:
(i) a heavy chain variable region (vH) comprising a sequence as set forth in SEQ ID NO: 2506 to 2680 or 12160 to 12278 or a sequence with at least 95% identity thereto that contains the CDRs of SEQ ID NO: 2506 to 2680 or 12160 to 12278 and which binds to its antigen; and a complementary light chain variable region (vL) comprising a sequence as set forth SEQ ID NO: 2307 to 2482 or 12042 to 12159 or a sequence with at least 95% identity thereto that contains the CDRs of SEQ ID NO: 2307 to 2482 or 12042 to 12159 and which binds to its antigen;
(ii) a single chain variable fragment (scFv) comprising a sequence as set forth in SEQ ID NO: 2770 to 2939, 12303 to 12357, or 18162 to 18224 or a sequence with at least 95% identity thereto that contains the CDRs of SEQ ID NO: 2770 to 2939, 12303 to 12357, or 18162 to 18224 and which binds to its antigen;
(iii) a camelid VHH domain comprising a sequence as set forth in SEQ ID NO: 2701 to 2725 or 12279 to 12294 or a sequence with at least 95% identity thereto that contains the CDRs of SEQ ID NO: 2701 to 2725 or 12279 to 12294 and which binds to its antigen;
(iv) a non-immunoglobulin scaffold encoded by a polynucleotide of SEQ ID NO: 439 to 443 or a sequence with at least 95% identity thereto that contains the CDRs of SEQ ID NO: 439 to 443 and which binds to its antigen;
(v) a receptor comprising a sequence as set forth in SEQ ID NO: 2736 to 2748 or a sequence with at least 95% identity thereto and which binds to its cognate;
(vi) a ligand comprising a sequence as set forth in SEQ ID NO: 2758 to 2768 or 12359 to 12361 or a sequence with at least 95% identity thereto that contains the CDRs of SEQ ID NO: 2758 to 2768 or 12359 to 12361 and which binds to its cognate; and
(vii) a light chain variable region (vL) comprising three light chain complementary determining regions for a selected target antigen as set forth in SEQ ID NO: 13999 to 14879 or 14880 and a complementary heavy chain variable region (VH) comprising three heavy chain complementary determining regions for a selected target antigen as set forth in SEQ ID NO: 14881 to 15761 or 15762.

19. The isolated synthetic immune receptor (SIR) polypeptide heterodimer of claim 13, wherein said one or more non-natural TCR antigen binding domain(s) are selected from the group consisting of:
(i) a variable light (vL) domain comprising a sequence of SEQ ID NO: 2307 to 2482 or 12042 to 12159 having up to 10 conservative amino acid substitutions that contains the CDRs of SEQ ID NO: 2307 to 2482 or 12042 to 12159; and a complementary variable heavy (vH) domain comprising a sequence SEQ ID NO: 2506 to 2680 or 12160 to 12278 having up to 10 conservative amino acid substitutions that contains the CDRs of SEQ ID NO: 2506 to 2680 or 12160 to 12278;
(ii) one or more of camelid vHH domains as set forth in SEQ ID NO: 2701 to 2725 or 12279 to 12294 having up to 10 conservative amino acid substitutions that contains the CDRs of SEQ ID NO: 2701 to 2725 or 12279 to 12294;
(iii) a non-immunoglobulin antigen binding domain having a sequence as set forth in SEQ ID NO: 2728-2732 or 12296 to 12301 and having up to 10 conservative amino acid substitutions;
(iv) an scFv domain comprising three light chain complementary determining regions of a variable light (vL) domain comprising a sequence of SEQ ID NO: 2307 to 2482 or 12042 to 12159 and three heavy chain complementary determining regions of a variable heavy (vH) domain comprising a sequence of SEQ ID NO: 2506 to 2680 or 12160 to 12278;
(v) an scFv fragment having a sequence selected from the group consisting of SEQ ID NO: 2770 to 2939, 12303 to 12357 or 18162 to 18224 each having up to 10 conservative amino acid substitutions and containing the CDRs of SEQ ID NO: 2770 to 2939, 12303 to 12357 or 18162 to 18224;
(vi) one or more receptors comprising the amino acid sequence of SEQ ID NO: 2736 to 2748 having up to 10 conservative amino acid substitutions;
(vii) one or more ligands comprising the sequence of SEQ ID NO: 2758-2768 or 12359 to 12361 having up to 10 conservative amino acid substitutions;
(viii) an extracellular domain of CD16A, NKG2D, CD4, PD1, desmoglein 3 (Dsg3), or CD4-DC-SIGN;
(ix) an extracellular domain of one or more of hTPO, mTPO, CGHα chain, CGHβ chain, FHβ chain, LHβ chain, TSHβ chain, APRIL or a combination thereof; and
(x) any combination of (i)-(ix).

20. A recombinant immune effector cell or stem cell that can differentiate into an immune effector cell comprising at least one polypeptide heterodimer of claim 13.

21. The recombinant immune effector cell or stem cell that can differentiate into an immune effector cell of claim 20 or 11, wherein (a) the immune effector cell is selected from the group consisting of an alpha/beta T cell, a gamma/delta T cell, regulatory T cell (TREG), CD8+ T cell, a CD4+ T cell, B cell, natural killer (NK) cell, natural killer T (NKT) cell, synthetic T cell, and a myeloid-derived phagocyte; (b) the stem cell is selected from the group consisting of a hematopoietic stem cell, a peripheral blood stem cell, a bone marrow derived stem cell, an immune stem cell, a lymphoid stem cell, embryonic stem cell, and an induced pluripotent stem cell (iPSC); or (c) the immune effector cell of (a) or stem cell of (b) is autologous, allogeneic, syngeneic or xenogeneic.

22. The recombinant immune effector cell or stem cell that can differentiate into an immune effector cell of claim 20, wherein the immune effector cell further comprises:
(a) at least one chimeric antigen receptor (CAR) polypeptide, wherein the CAR comprises:
(i) an antigen binding domain, a transmembrane domain and an intracellular domain of an inhibitory molecule,
(ii) an antigen binding domain, a transmembrane domain, and a primary signaling domain,
(iii) an antigen binding domain, a transmembrane domain, a costimulatory signaling domain but no primary signaling domain, or
(iv) an antigen binding domain, a transmembrane domain, a primary signaling domain and a costimulatory domain;
(b) reduced or eliminated expression of an endogenous TCR;
(c) reduced or eliminated expression of one or more subunits that comprise a functional endogenous TCR;
(d) lacks expression of one or more TCR chains selected from the group consisting of TCRa, TCRB1, TCRB2, TCRY, TCR8 and pre-TCRa;
(e) a impaired endogenous TCR;
(f) loss of expression or decreased expression of a functional HLA;
(g) loss of expression or decreased expression of β2 microglobulin;
(h) a deletion or mutation in one or more target antigens to a form that is no longer recognized by the SIR;
(i) deletion of diaglycerol kinase (DGK) or ikaros;
(j) an agent that increases the expression and/or activity of the SIR, wherein the agent is selected from CD3ζ, CD3δ, CD3ε, CD3γ or combination thereof;
(k) an agent that enhances the activity of SIR-expressing cell;
(l) an agent that inhibits an inhibitory molecule;
(m) an agent that inhibits the expression of one or more target antigens;
(n) an agent that provides co-stimulation to a SIR-expressing cell;
(o) a cytokine and/or a chemokine;
(p) an agent that that promotes the proliferation, persistence, expansion and activation of a SIR-expressing cell;
(q) a soluble receptor;
(r) a second SIR;
(s) an accessory module selected from the group consisting of 41BBL, CD40L, K13, MC159, cFLIP-L/MRITa, cFLIP-p22, HTLV1 Tax, HTLV2 Tax, HTLV2, Tax-RS mutant, FKBPx2-K13, FKBPx2-HTLV2-Tax, FKBPx2-HTLV2-Tax-RS, IL6R-304-vHH-Alb8-vHH, IL12f, PD1-4H1 scFV, PD1-5C4 scFV, PD1-4H1-Alb8-vHH, PD1-5C4-Alb8-vHH, CTLA4-Ipilimumab-scFv, CTLA4-Ipilimumab-Alb8-vHH, IL6-19A-scFV, IL6-19A-scFV-Alb8-vHH, sHVEM, sHVEM-Alb8-vHH, hTERT, Fx06, CD3z, CD3z-GGGS-41 BB, CD3-BBz, CD3-CD28z, CD3-CD28-Lck fusion protein, shRNA targeting Brd4, hTERT, heparinase, cytokine, chemokine, IL2, IL-7, IL-15, IL12f, IL-21, a costimulatory agent, soluble receptor, and any combination thereof; or
(t) a therapeutic control, wherein the therapeutic control is optionally selected from the group consisting of a truncated epidermal growth factor receptor (tEGFR), truncated epidermal growth factor receptor viii (tEGFRviii), truncated CD30 (tCD30), truncated BCMA (tBCMA), truncated CD19 (tCD19), CD34, thymidine kinase, cytosine deaminase, nitroreductase, xanthine-guanine phosphoribosyl transferase, human caspase 8, human caspase 9, inducible caspase 9 (icaspase9), purine nucleoside phosphorylase, linamarase/linamarin/glucose oxidase, deoxyribonucleoside kinase, horseradish peroxidase (HRP)/indole-3-acetic (IAA), Gamma-glutamylcysteine synthetase, CD20/alphaCD20, CD34/thymidine kinase chimera, dox-dependent caspase-2, mutant thymidine kinase (HSV- TKSR39), AP1903/Fas system, a chimeric cytokine receptor (CCR), a selection marker, dihydroxyfolate receptor (DHFR), mutant DHFR, methylated-DNA-protein-cysteine methyltransferase, inosine monophosphate dehydrogenase II (IMDHP2), puromycin acetyle transferase (PAC), blasticidin-resistance gene, mutant calcinueurin a/b (Can/b), CNa12, CNb30, a suicide gene and combinations thereof.

23. The isolated synthetic immune receptor (SIR) polypeptide heterodimer of claim 13 comprising a heterodimer of two T-cell receptor (TCR) constant chains comprising the amino acid sequences of SEQ ID NOs: 3010 and 3024 with mutations at the following amino acid positions:
  a) SEQ ID NO: 3010 with 48C and SEQ ID NO: 3024 with 57C; or
  b) SEQ ID NO: 3010 with 15C and SEQ ID NO: 3024 with 15C; or
  c) SEQ ID NO: 3010 with 45C and SEQ ID NO: 3024 with 59C; or
  d) SEQ ID NO: 3010 with 45C and SEQ ID NO: 3024 with 77C; or
  e) SEQ ID NO: 3010 with 10C and SEQ ID NO: 3024 with 17C; or
  f) SEQ ID NO: 3010 with 91S, 92D, 93V and/or 94P and any of the forgoing mutations listed for SEQ ID NO: 3010 in (a)-(e), and SEQ ID NO: 3024 with 18K/R, 22A, 133I, 136A and/or 139H and any of the forgoing mutations listed for SEQ ID NO: 3024 in (a)-(e); or
  g) SEQ ID NO: 3010 with 61R and SEQ ID NO: 3024 with 79G; or
  h) any combination of mutations set forth in (a)-(g).

* * * * *